United States Patent
Kotin et al.

(10) Patent No.: US 10,577,627 B2
(45) Date of Patent: Mar. 3, 2020

(54) CHIMERIC CAPSIDS

(71) Applicant: VOYAGER THERAPEUTICS, INC., Cambridge, MA (US)

(72) Inventors: Robert Kotin, Boston, MA (US); Jinzhao Hou, Belmont, MA (US); James McLaughlin, Cambridge, MA (US)

(73) Assignee: Voyager Therapeutics, Inc., Cambridge, MA (US)

( * ) Notice: Subject to any disclaimer, the term of this patent is extended or adjusted under 35 U.S.C. 154(b) by 102 days.

(21) Appl. No.: 15/317,448

(22) PCT Filed: Jun. 9, 2015

(86) PCT No.: PCT/US2015/034799
§ 371 (c)(1),
(2) Date: Dec. 9, 2016

(87) PCT Pub. No.: WO2015/191508
PCT Pub. Date: Dec. 17, 2015

(65) Prior Publication Data
US 2017/0130245 A1    May 11, 2017

Related U.S. Application Data

(60) Provisional application No. 62/009,430, filed on Jun. 9, 2014, provisional application No. 62/009,435, filed on Jun. 9, 2014.

(51) Int. Cl.
*C12N 15/861* (2006.01)
*C12N 15/86* (2006.01)
*C07K 14/005* (2006.01)

(52) U.S. Cl.
CPC ............ *C12N 15/86* (2013.01); *C07K 14/005* (2013.01); *C12N 2750/14122* (2013.01); *C12N 2750/14143* (2013.01); *C12N 2750/14145* (2013.01)

(58) Field of Classification Search
CPC combination set(s) only.
See application file for complete search history.

(56) References Cited

U.S. PATENT DOCUMENTS

| | | | |
|---|---|---|---|
| 5,064,764 A | 11/1991 | Besnainon |
| 5,474,935 A | 12/1995 | Chatterjee |
| 5,587,308 A | 12/1996 | Carter |
| 5,652,224 A | 7/1997 | Wilson |
| 5,658,785 A | 8/1997 | Johnson |
| 5,688,676 A | 11/1997 | Zhou |
| 5,691,176 A | 11/1997 | Lebkowski |
| 5,693,531 A | 12/1997 | Chiorini |
| 5,741,683 A | 4/1998 | Zhou |
| 5,756,283 A | 5/1998 | Wilson |
| 5,856,152 A | 1/1999 | Wilson |
| 5,858,351 A | 1/1999 | Podsakoff |
| 5,858,775 A | 1/1999 | Johnson |
| 5,866,552 A | 2/1999 | Wilson |
| 5,866,696 A | 2/1999 | Carter |
| 5,871,982 A | 2/1999 | Wilson |
| 5,952,221 A | 9/1999 | Kurtzman |
| 5,962,313 A | 10/1999 | Podsakoff |
| 5,989,540 A | 11/1999 | Carter |
| 6,083,716 A | 7/2000 | Wilson |
| 6,143,548 A | 11/2000 | ORiordan |
| 6,143,567 A | 11/2000 | Van Agthoven |
| 6,146,874 A | 11/2000 | Zolotukhin |
| 6,156,303 A | 12/2000 | Russell |
| 6,174,527 B1 | 1/2001 | Wilson |
| 6,180,613 B1 | 1/2001 | Kaplitt |
| 6,194,191 B1 | 2/2001 | Zhang |
| 6,200,560 B1 | 3/2001 | Couto |
| 6,204,059 B1 | 3/2001 | Samulski |
| 6,211,163 B1 | 4/2001 | Podsakoff |
| 6,251,677 B1 | 6/2001 | Wilson |
| 6,258,595 B1 | 7/2001 | Gao |
| 6,261,551 B1 | 7/2001 | Wilson |
| 6,265,389 B1 | 7/2001 | Burke |
| 6,270,996 B1 | 8/2001 | Wilson |
| 6,274,354 B1 | 8/2001 | Wilson |
| 6,281,010 B1 | 8/2001 | Gao |
| 6,325,998 B1 | 12/2001 | Podsakoff |
| 6,335,011 B1 | 1/2002 | Podsakoff |
| 6,365,394 B1 | 4/2002 | Gao |
| 6,387,368 B1 | 5/2002 | Wilson |
| 6,399,385 B1 | 6/2002 | Croyle |
| 6,410,300 B1 | 6/2002 | Samulski |
| 6,416,992 B1 | 7/2002 | Mejza |
| 6,428,988 B1 | 8/2002 | Wilson |
| 6,436,392 B1 | 8/2002 | Engelhardt |

(Continued)

FOREIGN PATENT DOCUMENTS

| EP | 1015619 | 7/2000 |
|---|---|---|
| EP | 1046711 | 10/2000 |

(Continued)

OTHER PUBLICATIONS

International Search Report dated Nov. 23, 2015 received in corresponding PCT Application No. PCT/US2015/034799.
Extended EP Search Report which includes Supplementary European Search Report and European Search Opinion dated Oct. 24, 2017 for EP Application No. 15807546, filed Jun. 9, 2015.
Hauck, et al., 2003, "Generation and characterization of chimeric recombinant AAV vectors". Mol Ther. 7(3):419-425.
Li, et al., 2008, "Engineering and selection of shuffled AAV genomes: a new strategy for producing targeted biological nanoparticles". Mol Ther. 16(7):1252-1260.
Muzyczka et al., 2005, "Custom adeno-associated virus capsids: the next generation of recombinant vectors with novel tropism". Hum Gene Ther. 16(4):408-416.

(Continued)

*Primary Examiner* — Thaian N. Ton
(74) *Attorney, Agent, or Firm* — DT Ward, PC; Donna T. Ward; Mark J. Hanson

(57) ABSTRACT

The present invention relates to viral vectors and methods of their production and use.

28 Claims, 10 Drawing Sheets
Specification includes a Sequence Listing.

(56) References Cited

U.S. PATENT DOCUMENTS

| | | |
|---|---|---|
| 6,436,394 B1 | 8/2002 | Henderson |
| 6,468,524 B1 | 10/2002 | Chiorini |
| 6,468,771 B1 | 10/2002 | Einerhand |
| 6,475,769 B1 | 11/2002 | Wilson |
| 6,482,634 B1 | 11/2002 | Wilson |
| 6,485,966 B2 | 11/2002 | Gao |
| 6,491,907 B1 | 12/2002 | Rabinowitz |
| 6,503,888 B1 | 1/2003 | Kaplitt |
| 6,509,150 B1 | 1/2003 | Salvetti |
| 6,521,426 B1 | 2/2003 | Ciliberto |
| 6,555,525 B2 | 4/2003 | Burke |
| 6,566,118 B1 | 5/2003 | Atkinson |
| 6,582,692 B1 | 6/2003 | Podsakoff |
| 6,593,123 B1 | 7/2003 | Wright |
| 6,610,290 B2 | 8/2003 | Podsakoff |
| 6,642,051 B1 | 11/2003 | Lynch |
| 6,660,514 B1 | 12/2003 | Zolotukhin |
| 6,660,521 B2 | 12/2003 | Brough |
| 6,670,176 B1 | 12/2003 | Samulski |
| 6,676,935 B2 | 1/2004 | Henderson |
| 6,699,706 B1 | 3/2004 | Brooks |
| 6,710,036 B2 | 3/2004 | Kurtzman |
| 6,723,551 B2 | 4/2004 | Kotin |
| 6,726,907 B1 | 4/2004 | Zhang |
| 6,753,419 B1 | 6/2004 | Toniatti |
| 6,759,237 B1 | 7/2004 | Wilson |
| 6,846,665 B1 | 1/2005 | Horer |
| 6,855,314 B1 | 2/2005 | Chiorini |
| 6,887,463 B2 | 5/2005 | Wilson |
| 6,897,045 B2 | 5/2005 | Engelhardt |
| 6,943,019 B2 | 9/2005 | Wilson |
| 6,953,690 B1 | 10/2005 | Gao |
| 6,984,517 B1 | 1/2006 | Chiorini |
| 6,995,006 B2 | 2/2006 | Atkinson |
| 7,015,026 B2 | 3/2006 | ORiordan |
| 7,022,519 B2 | 4/2006 | Gao |
| 7,048,920 B2 | 5/2006 | Yu |
| 7,056,502 B2 | 6/2006 | Hildinger |
| 7,070,998 B2 | 7/2006 | Johnson |
| 7,091,030 B2 | 8/2006 | Setiawan |
| 7,094,604 B2 | 8/2006 | Snyder |
| 7,105,345 B2 | 9/2006 | Wilson |
| 7,112,321 B2 | 9/2006 | Wang |
| 7,125,705 B2 | 10/2006 | Colosi |
| 7,125,706 B2 | 10/2006 | Zhang |
| 7,169,612 B2 | 1/2007 | Kostenis |
| 7,172,893 B2 | 2/2007 | Rabinowitz |
| 7,186,552 B2 | 3/2007 | Wilson |
| 7,198,951 B2 | 4/2007 | Gao |
| 7,223,585 B2 | 5/2007 | Coffey |
| 7,235,393 B2 | 6/2007 | Gao |
| 7,238,526 B2 | 7/2007 | Wilson |
| 7,241,447 B1 | 7/2007 | Engelhardt |
| 7,247,472 B2 | 7/2007 | Wilson |
| 7,271,002 B2 | 9/2007 | Kotin |
| 7,282,199 B2 | 10/2007 | Gao |
| 7,291,498 B2 | 11/2007 | Roy |
| 7,300,797 B2 | 11/2007 | Van Agthoven |
| 7,306,794 B2 | 12/2007 | Wilson |
| 7,319,002 B2 | 1/2008 | Wilson |
| 7,326,555 B2 | 2/2008 | Konz |
| 7,344,872 B2 | 3/2008 | Gao |
| 7,419,817 B2 | 9/2008 | Chiorini |
| 7,419,956 B2 | 9/2008 | Ohtaki |
| 7,445,930 B2 | 11/2008 | Zhang |
| 7,479,554 B2 | 1/2009 | Chiorini |
| 7,491,508 B2 | 2/2009 | Roy |
| 7,510,872 B2 | 3/2009 | Clark |
| 7,510,875 B2 | 3/2009 | Zhang |
| 7,579,181 B2 | 8/2009 | ORiordan |
| 7,625,570 B1 | 12/2009 | Schaffer |
| 7,638,120 B2 | 12/2009 | Liu |
| 7,662,627 B2 | 2/2010 | Johnson |
| 7,704,492 B2 | 4/2010 | Podsakoff |
| 7,704,721 B2 | 4/2010 | Wright |
| 7,732,129 B1 | 6/2010 | Zhang |
| 7,749,492 B2 | 7/2010 | Bartlett |
| 7,790,449 B2 | 9/2010 | Gao |
| 7,803,622 B2 | 9/2010 | Engelhardt |
| 7,838,277 B2 | 11/2010 | Gao |
| 7,888,096 B2 | 2/2011 | Wu |
| 7,901,921 B2 | 3/2011 | Coffey |
| 7,906,111 B2 | 3/2011 | Wilson |
| 7,968,333 B2 | 6/2011 | Yu |
| 8,105,574 B2 | 1/2012 | Wilson |
| 8,110,351 B2 | 2/2012 | Bosnes |
| 8,137,948 B2 | 3/2012 | Qu |
| 8,163,543 B2 | 4/2012 | Urabe |
| 8,231,880 B2 | 7/2012 | Roy |
| 8,236,495 B2 | 8/2012 | Nochumson |
| 8,241,622 B2 | 8/2012 | Englehardt |
| 8,273,344 B2 | 9/2012 | Wang |
| 8,283,151 B2 | 10/2012 | Schmidt |
| 8,318,480 B2 | 11/2012 | Gao |
| 8,318,687 B2 | 11/2012 | Tabira |
| 8,394,386 B2 | 3/2013 | Wilson |
| 8,409,842 B2 | 4/2013 | Clark |
| 8,470,310 B2 | 6/2013 | Roy |
| 8,476,418 B2 | 7/2013 | Mueller |
| 8,512,981 B2 | 8/2013 | Hermens |
| 8,524,219 B2 | 9/2013 | Roy |
| 8,524,446 B2 | 9/2013 | Gao |
| 8,603,459 B2 | 12/2013 | Wilson |
| 8,614,101 B2 | 12/2013 | VanDine |
| 8,637,255 B2 | 1/2014 | Wilson |
| 8,642,314 B2 | 2/2014 | Bakker |
| 8,685,734 B2 | 4/2014 | Coffey |
| 8,697,417 B2 | 4/2014 | Bakker |
| 8,697,665 B2 | 4/2014 | Fontanellas Rom |
| 8,834,863 B2 | 9/2014 | Roy |
| 8,846,030 B2 | 9/2014 | Engelhardt |
| 8,846,389 B2 | 9/2014 | Chiorini |
| 8,906,387 B2 | 12/2014 | Kay |
| 8,906,675 B2 | 12/2014 | Gao |
| 8,927,514 B2 | 1/2015 | Chatterjee |
| 8,962,330 B2 | 2/2015 | Gao |
| 8,962,332 B2 | 2/2015 | Gao |
| 8,999,678 B2 | 4/2015 | Vandenberghe |
| 9,051,542 B2 | 6/2015 | Wright |
| 9,056,892 B2 | 6/2015 | Pun |
| 9,080,183 B2 | 7/2015 | Klein |
| 9,089,667 B2 | 7/2015 | Bankiewicz |
| 9,102,943 B2 | 8/2015 | Shinmura |
| 9,115,373 B2 | 8/2015 | Hermens |
| 9,163,260 B2 | 10/2015 | Wilson |
| 9,217,155 B2 | 12/2015 | Gao |
| 9,217,159 B2 | 12/2015 | Roy |
| 9,228,174 B2 | 1/2016 | Noordman |
| 9,233,174 B2 | 1/2016 | Chen |
| 9,238,800 B2 | 1/2016 | Bossis |
| 9,260,724 B2 | 2/2016 | Bakker |
| 9,439,979 B2 | 9/2016 | Chiorini |
| 9,441,206 B2 | 9/2016 | Grieger |
| 9,441,244 B2 | 9/2016 | Schaffer |
| 9,447,433 B2 | 9/2016 | Hirsch |
| 9,457,103 B2 | 10/2016 | Schaffer |
| 9,458,517 B2 | 10/2016 | Schaffer |
| 9,464,119 B2 | 10/2016 | Sonntag |
| 9,475,845 B2 | 10/2016 | Asokan |
| 9,493,788 B2 | 11/2016 | Gao |
| 9,506,083 B2 | 11/2016 | Arbetman |
| 9,528,126 B2 | 12/2016 | Qu |
| 9,540,659 B2 | 1/2017 | Davidson |
| 9,546,112 B2 | 1/2017 | Voit |
| 9,546,369 B2 | 1/2017 | Gao |
| 9,567,376 B2 | 2/2017 | Cronin |
| 9,567,607 B2 | 2/2017 | Wilson |
| 9,580,691 B2 | 2/2017 | Bakker |
| 9,585,971 B2 | 3/2017 | Deverman |
| 9,587,250 B2 | 3/2017 | Gao |
| 9,587,282 B2 | 3/2017 | Schaffer |
| 9,593,346 B2 | 3/2017 | Roy |
| 9,596,835 B2 | 3/2017 | Gao |
| 9,597,363 B2 | 3/2017 | Roy |

(56) References Cited

U.S. PATENT DOCUMENTS

| Patent/Publication | Date | Inventor |
|---|---|---|
| 9,598,468 B2 | 3/2017 | Weigel-Van Aken |
| 9,598,703 B2 | 3/2017 | Garcia |
| 9,611,302 B2 | 4/2017 | Srivastava |
| 9,617,561 B2 | 4/2017 | Roy |
| 9,623,120 B2 | 4/2017 | Chatterjee |
| 9,624,274 B2 | 4/2017 | Lux |
| 9,636,370 B2 | 5/2017 | McCown |
| 9,670,507 B2 | 6/2017 | Xiao |
| 9,677,088 B2 | 6/2017 | Nakai |
| 9,677,089 B2 | 6/2017 | Gao |
| 9,695,220 B2 | 7/2017 | Vandenberghe |
| 9,701,984 B2 | 7/2017 | Gao |
| 9,719,070 B2 | 8/2017 | Vandenberghe |
| 9,725,485 B2 | 8/2017 | Srivastava |
| 9,737,618 B2 | 8/2017 | Wilson |
| 9,775,918 B2 | 10/2017 | Zhong |
| 9,777,291 B2 | 10/2017 | Chatterjee |
| 9,783,825 B2 | 10/2017 | Chatterjee |
| 9,790,472 B2 | 10/2017 | Gao |
| 9,803,218 B2 | 10/2017 | Chatterjee |
| 10,046,016 B2 | 8/2018 | Schaffer |
| 10,047,128 B2 | 8/2018 | Judd |
| 10,072,251 B2 | 9/2018 | Gao |
| 10,077,291 B2 | 9/2018 | Asokan |
| 10,190,098 B2 | 1/2019 | Bakker |
| 10,214,572 B2 | 2/2019 | Boye |
| 2001/0006955 A1 | 7/2001 | Wilson |
| 2001/0049144 A1 | 12/2001 | Rivera |
| 2002/0019050 A1 | 2/2002 | Gao |
| 2002/0037867 A1 | 3/2002 | Wilson |
| 2002/0081721 A1 | 6/2002 | Allen |
| 2002/0090717 A1 | 7/2002 | Gao |
| 2002/0102714 A1 | 8/2002 | Wilson |
| 2002/0131961 A1 | 9/2002 | Wilson |
| 2003/0013189 A1 | 1/2003 | Wilson |
| 2003/0032613 A1 | 2/2003 | Gao |
| 2003/0092161 A1 | 5/2003 | Gao |
| 2003/0100115 A1 | 5/2003 | Raj |
| 2003/0119191 A1 | 6/2003 | Gao |
| 2003/0138772 A1 | 7/2003 | Gao |
| 2004/0043490 A1 | 3/2004 | Shimada |
| 2004/0057931 A1 | 3/2004 | Wilson |
| 2004/0136963 A1 | 7/2004 | Wilson |
| 2004/0171807 A1 | 9/2004 | Gao |
| 2005/0261218 A1 | 11/2005 | Esau |
| 2006/0003451 A1 | 1/2006 | Gao |
| 2006/0204479 A1 | 9/2006 | Wilson |
| 2007/0004042 A1 | 1/2007 | Gao |
| 2008/0008684 A1 | 1/2008 | Wilson |
| 2008/0050343 A1 | 2/2008 | Wilson |
| 2008/0050345 A1 | 2/2008 | Wilson |
| 2008/0075737 A1 | 3/2008 | Gao |
| 2008/0269149 A1 | 10/2008 | Bowles et al. |
| 2009/0215871 A1 | 8/2009 | Wilson |
| 2009/0275107 A1 | 11/2009 | Lock |
| 2009/0317417 A1 | 12/2009 | Vandenberghe |
| 2010/0247490 A1 | 9/2010 | Roy |
| 2010/0278791 A1 | 11/2010 | Wilson |
| 2011/0104119 A1* | 5/2011 | Bowles .................. C12N 15/86 424/93.2 |
| 2011/0136227 A1 | 6/2011 | Bakker |
| 2011/0171262 A1 | 7/2011 | Bakker |
| 2011/0223135 A1 | 9/2011 | Roy |
| 2011/0229971 A1 | 9/2011 | Knop |
| 2012/0046349 A1 | 2/2012 | Bell |
| 2012/0058102 A1 | 3/2012 | Wilson |
| 2012/0093853 A1 | 4/2012 | Wilson |
| 2012/0137379 A1 | 5/2012 | Gao |
| 2012/0220648 A1 | 8/2012 | Hwu et al. |
| 2012/0258046 A1 | 10/2012 | Mutzke |
| 2013/0023033 A1 | 1/2013 | Wilson |
| 2013/0045186 A1 | 2/2013 | Gao |
| 2013/0101558 A1 | 4/2013 | Gao |
| 2013/0195801 A1 | 8/2013 | Gao |
| 2013/0296532 A1 | 11/2013 | Hermens |
| 2013/0323226 A1 | 12/2013 | Wilson |
| 2013/0323302 A1 | 12/2013 | Constable |
| 2014/0031418 A1 | 1/2014 | Wilson |
| 2014/0044680 A1 | 2/2014 | Roy |
| 2014/0065105 A1 | 3/2014 | Wilson |
| 2014/0087361 A1 | 3/2014 | Dobbelaer |
| 2014/0099666 A1 | 4/2014 | Rossomando |
| 2014/0107186 A1 | 4/2014 | Garcia |
| 2014/0336245 A1 | 11/2014 | Mingozzi |
| 2014/0341852 A1 | 11/2014 | Srivastava |
| 2014/0342434 A1 | 11/2014 | Hermens |
| 2015/0005369 A1 | 1/2015 | Muzyczka |
| 2015/0023924 A1 | 1/2015 | High |
| 2015/0065562 A1 | 3/2015 | Yazicioglu |
| 2015/0118287 A1 | 4/2015 | Hammond |
| 2015/0139952 A1 | 5/2015 | Webster |
| 2015/0159173 A1 | 6/2015 | Vandenberghe |
| 2015/0238610 A1 | 8/2015 | Sista |
| 2015/0307898 A2 | 10/2015 | Hermens |
| 2015/0315610 A1 | 11/2015 | Nishie |
| 2015/0374803 A1 | 12/2015 | Wolfe |
| 2016/0032319 A1 | 2/2016 | Wright |
| 2016/0108373 A1 | 4/2016 | Bennett |
| 2016/0153992 A1 | 6/2016 | Buening |
| 2016/0166709 A1 | 6/2016 | Davidson |
| 2016/0271192 A1 | 9/2016 | Roy |
| 2016/0273058 A1 | 9/2016 | Akashika |
| 2016/0289275 A1 | 10/2016 | Chiorini |
| 2016/0296694 A1 | 10/2016 | Bankiewicz |
| 2016/0331897 A1 | 11/2016 | Anand |
| 2016/0333372 A1 | 11/2016 | Srivastava |
| 2016/0333373 A1 | 11/2016 | Farley |
| 2016/0333375 A1 | 11/2016 | Chen |
| 2016/0340393 A1 | 11/2016 | Schaffer |
| 2016/0340692 A1 | 11/2016 | Wang |
| 2016/0361439 A1 | 12/2016 | Agbandje-McKenna |
| 2016/0369298 A1 | 12/2016 | Marsic |
| 2016/0369299 A1 | 12/2016 | Boye |
| 2016/0375151 A1 | 12/2016 | Schaffer |
| 2016/0376323 A1 | 12/2016 | Schaffer |
| 2016/0376608 A1 | 12/2016 | Chou |
| 2017/0000904 A1 | 1/2017 | Wilson |
| 2017/0007669 A1 | 1/2017 | Sarkar |
| 2017/0007720 A1 | 1/2017 | Boye |
| 2017/0028082 A1 | 2/2017 | Wilson |
| 2017/0044504 A1 | 2/2017 | Schaffer |
| 2017/0067028 A1 | 3/2017 | Ballon |
| 2017/0071972 A1 | 3/2017 | Buj Bello |
| 2017/0073703 A1 | 3/2017 | Chatterjee |
| 2017/0088858 A1 | 3/2017 | Gao |
| 2017/0096646 A1 | 4/2017 | Roy |
| 2017/0105927 A1 | 4/2017 | Thorne |
| 2017/0112946 A1 | 4/2017 | Ikeda |
| 2017/0121734 A1 | 5/2017 | Cairns |
| 2017/0128594 A1 | 5/2017 | Wright |
| 2017/0130208 A1 | 5/2017 | Potter |
| 2017/0130245 A1 | 5/2017 | Kotin |
| 2017/0145440 A1 | 5/2017 | Hermens |
| 2017/0151348 A1 | 6/2017 | Kaspar |
| 2017/0151416 A1 | 6/2017 | Kutikov |
| 2017/0152525 A1 | 6/2017 | Hermens |
| 2017/0157267 A1 | 6/2017 | Kay |
| 2017/0159026 A1 | 6/2017 | Kay |
| 2017/0159027 A1 | 6/2017 | Wilson |
| 2017/0159072 A9 | 6/2017 | Arbeit |
| 2017/0165377 A1 | 6/2017 | Gao |
| 2017/0166871 A1 | 6/2017 | Nishie |
| 2017/0166925 A1 | 6/2017 | Gao |
| 2017/0166926 A1 | 6/2017 | Deverman |
| 2017/0166927 A1 | 6/2017 | Gao |
| 2017/0183636 A1 | 6/2017 | Roy |
| 2017/0191039 A1 | 7/2017 | Gao |
| 2017/0198304 A1 | 7/2017 | Wilson |
| 2017/0204144 A1 | 7/2017 | Deverman |
| 2017/0211092 A1 | 7/2017 | Chatterjee |
| 2017/0211093 A1 | 7/2017 | Chatterjee |
| 2017/0211094 A1 | 7/2017 | Chatterjee |
| 2017/0211095 A1 | 7/2017 | Chatterjee |
| 2017/0216458 A1 | 8/2017 | Kaspar |

(56) References Cited

U.S. PATENT DOCUMENTS

| | | |
|---|---|---|
| 2017/0240885 A1 | 8/2017 | Deverman |
| 2017/0240921 A1 | 8/2017 | Gao |
| 2017/0274024 A1 | 9/2017 | McCown |
| 2017/0275337 A1 | 9/2017 | Srivastava |
| 2017/0298323 A1 | 10/2017 | Vandenberghe |
| 2017/0306354 A1 | 10/2017 | Gao |
| 2018/0164140 A1 | 6/2018 | Carralero |
| 2018/0223312 A1 | 8/2018 | Srivastava |
| 2018/0230186 A1 | 8/2018 | Deverman |
| 2018/0230440 A1 | 8/2018 | Ho |
| 2018/0256752 A1 | 9/2018 | Buj Bello |
| 2018/0265863 A1 | 9/2018 | Esteves |
| 2019/0024117 A1 | 1/2019 | Gao |
| 2019/0055524 A1 | 2/2019 | Vandenberghe |

FOREIGN PATENT DOCUMENTS

| | | |
|---|---|---|
| EP | 1078096 | 2/2001 |
| EP | 1164195 | 12/2001 |
| EP | 1183380 | 3/2002 |
| EP | 1218035 | 7/2002 |
| EP | 1240345 | 9/2002 |
| EP | 1279740 | 1/2003 |
| EP | 1453547 | 9/2004 |
| EP | 1696036 | 8/2006 |
| EP | 1847614 | 10/2007 |
| EP | 1849872 | 10/2007 |
| EP | 1857552 | 11/2007 |
| EP | 1944043 | 7/2008 |
| EP | 2007795 | 12/2008 |
| EP | 2198016 | 6/2010 |
| EP | 2220241 | 8/2010 |
| EP | 2220242 | 8/2010 |
| EP | 2292779 | 3/2011 |
| EP | 2325298 | 5/2011 |
| EP | 2359866 | 8/2011 |
| EP | 2383346 | 11/2011 |
| EP | 2524037 | 11/2012 |
| EP | 2531604 | 12/2012 |
| EP | 2660325 | 11/2013 |
| EP | 2737071 | 6/2014 |
| EP | 2814958 | 12/2014 |
| EP | 2871239 | 5/2015 |
| EP | 2879719 | 6/2015 |
| EP | 2933336 | 10/2015 |
| EP | 2940131 | 11/2015 |
| EP | 3058959 | 8/2016 |
| EP | 3067417 | 9/2016 |
| EP | 2176283 | 11/2016 |
| EP | 3108000 | 12/2016 |
| EP | 3117005 | 1/2017 |
| EP | 3134431 | 3/2017 |
| EP | 3168298 | 5/2017 |
| EP | 3221453 A1 | 9/2017 |
| EP | 3390429 | 10/2018 |
| WO | 1993009239 | 5/1993 |
| WO | 1995034670 | 12/1995 |
| WO | 1996017947 | 6/1996 |
| WO | 1996023810 | 8/1996 |
| WO | 1996030540 | 10/1996 |
| WO | 1998010088 | 3/1998 |
| WO | 1999027110 | 6/1999 |
| WO | 1999043360 | 9/1999 |
| WO | 1999058700 | 11/1999 |
| WO | 1999061595 | 12/1999 |
| WO | 1999060146 | 5/2000 |
| WO | 2000024916 | 5/2000 |
| WO | 2000028004 A1 | 5/2000 |
| WO | 2000066780 | 11/2000 |
| WO | 2000075353 | 12/2000 |
| WO | 2001014539 | 3/2001 |
| WO | 2001023001 | 4/2001 |
| WO | 2001025465 | 4/2001 |
| WO | 2001032711 | 5/2001 |
| WO | 2001036623 | 5/2001 |
| WO | 2001042444 | 6/2001 |
| WO | 2001068888 | 9/2001 |
| WO | 2001096587 | 12/2001 |
| WO | 2002012525 | 2/2002 |
| WO | 2002014487 | 2/2002 |
| WO | 2002020748 | 3/2002 |
| WO | 2002070719 | 9/2002 |
| WO | 2002071843 | 9/2002 |
| WO | 2003010320 | 2/2003 |
| WO | 2003024502 | 3/2003 |
| WO | 2003042397 | 5/2003 |
| WO | 2003087382 | 10/2003 |
| WO | 2003087383 | 10/2003 |
| WO | 2004044003 | 5/2004 |
| WO | 2004083441 | 9/2004 |
| WO | 2004108922 | 12/2004 |
| WO | 2004111248 | 12/2004 |
| WO | 2005005610 | 1/2005 |
| WO | 2005012537 | 2/2005 |
| WO | 2005111220 | 11/2005 |
| WO | 2006102072 | 9/2006 |
| WO | 2007130519 | 11/2007 |
| WO | 2007148971 | 7/2009 |
| WO | 2009134681 | 11/2009 |
| WO | 2011038187 | 3/2011 |
| WO | 2011054976 | 5/2011 |
| WO | 2011122950 | 10/2011 |
| WO | 2010109053 | 11/2011 |
| WO | 2012057363 | 5/2012 |
| WO | 2012114090 | 8/2012 |
| WO | 2012144446 | 10/2012 |
| WO | 2013078199 | 5/2013 |
| WO | 2013164793 | 11/2013 |
| WO | 2013170078 | 11/2013 |
| WO | 2014160092 | 10/2014 |
| WO | 2014168953 | 10/2014 |
| WO | 2014170470 | 10/2014 |
| WO | 2014170480 | 10/2014 |
| WO | 2014172669 | 10/2014 |
| WO | 2014186579 | 11/2014 |
| WO | 2014193716 | 12/2014 |
| WO | 2014194132 | 12/2014 |
| WO | 2014201252 | 12/2014 |
| WO | 2015012924 | 1/2015 |
| WO | 2015013148 A2 | 1/2015 |
| WO | 2015018503 | 2/2015 |
| WO | 2014186746 | 3/2015 |
| WO | 2015031686 | 4/2015 |
| WO | 2015044292 | 4/2015 |
| WO | 2015048534 A1 | 4/2015 |
| WO | 2015060722 | 4/2015 |
| WO | 2015108610 | 7/2015 |
| WO | 2015114365 | 8/2015 |
| WO | 2015121501 | 8/2015 |
| WO | 2015124546 | 8/2015 |
| WO | 2015137802 | 9/2015 |
| WO | 2015127128 | 11/2015 |
| WO | 2015196179 | 12/2015 |
| WO | 2016019364 | 2/2016 |
| WO | 2016054554 | 4/2016 |
| WO | 2016054557 | 4/2016 |
| WO | 2016065001 | 4/2016 |
| WO | 2016081811 | 5/2016 |
| WO | 2016081927 | 5/2016 |
| WO | 2016115382 | 7/2016 |
| WO | 2016122791 | 8/2016 |
| WO | 2016126857 | 8/2016 |
| WO | 2016130591 | 8/2016 |
| WO | 2016137949 | 9/2016 |
| WO | 2016154055 | 9/2016 |
| WO | 2016154344 | 9/2016 |
| WO | 2016164609 | 10/2016 |
| WO | 2016168728 | 10/2016 |
| WO | 2016172008 | 10/2016 |
| WO | 2016172155 | 10/2016 |
| WO | 2016179496 | 11/2016 |
| WO | 2016183297 | 11/2016 |
| WO | 2016191418 | 12/2016 |
| WO | 2016196507 | 12/2016 |

(56) References Cited

FOREIGN PATENT DOCUMENTS

| | | |
|---|---|---|
| WO | 2017004514 | 1/2017 |
| WO | 2017005806 | 1/2017 |
| WO | 2017015102 | 1/2017 |
| WO | 2017019876 | 2/2017 |
| WO | 2017019994 | 2/2017 |
| WO | 2017027866 | 2/2017 |
| WO | 2017058892 | 4/2017 |
| WO | 2017070476 | 4/2017 |
| WO | 2017070516 | 4/2017 |
| WO | 2017070525 | 4/2017 |
| WO | 2017070678 | 4/2017 |
| WO | 2017075335 | 5/2017 |
| WO | 2017083423 | 5/2017 |
| WO | 2017093330 | 6/2017 |
| WO | 2017096039 | 6/2017 |
| WO | 2017100671 | 6/2017 |
| WO | 2017100674 | 6/2017 |
| WO | 2017100676 | 6/2017 |
| WO | 2017100704 | 6/2017 |
| WO | 2017106326 A1 | 6/2017 |
| WO | 2017143100 A1 | 8/2017 |
| WO | 2017165859 A1 | 9/2017 |
| WO | 2017180854 A1 | 10/2017 |
| WO | 2018156654 A1 | 8/2018 |
| WO | 2018170310 A1 | 9/2018 |
| WO | 2018191750 A3 | 10/2018 |
| WO | 2019006046 A1 | 1/2019 |
| WO | 2019006182 A1 | 1/2019 |

OTHER PUBLICATIONS

Wu Y, et al. A Recombinant Baculovirus Efficiently Generates Recombinant Adeno-Associated Virus Vectors in Cultured Insect Cells and Larvae. Mol Ther Meth Clin Dev. Jul. 4, 2018;10:38-47.
Zhang Y, et al. Identification of adeno-associated virus capsid proteins using ZipChip CE/MS. Anal Biochem. Aug. 15, 2018;555:22-25.
Nass SA, et al. Universal Method for the Purification of Recombinant AAV Vectors of Differing Serotypes. Mol Ther Methods Clin Dev. Dec. 22, 2017;9:33-46.
Maurer AC, et al. The Assembly-Activating Protein Promotes Stability and Interactions between AAV's Viral Proteins to Nucleate Capsid Assembly. Cell Rep. May 8, 2018;23(6):1817-1830.
Penaud-Budloo M, et al. Pharmacology of Recombinant Adeno-associated Virus Production. Mol Ther Methods Clin Dev. Jan. 8, 2018;8:166-180.
Kelemen RE, et al. A precise chemical strategy to alter the receptor specificity of the adeno-associated virus. Angew Chem Int Ed Engl. Aug. 26, 2016;55(36):10645-9.
Powers JM, et al. A Quantitative Dot Blot Assay for AAV Titration and Its Use for Functional Assessment of the Adeno-associated Virus Assembly-activating Proteins. J Vis Exp. Jun. 12, 2018;(136). [Abstract only].
Giles AR, et al. Deamidation of Amino Acids on the Surface of Adeno-Associated Virus Capsids Leads to Charge Heterogeneity and Altered Vector Function.Mol Ther. Dec. 5, 2018;26(12):2848-2862.
Mietzsch M, et al. OneBac 2.0: Sf9 cell lines for production of AAV5 vectors with enhanced infectivity and minimal encapsidation of foreign DNA. Hum Gene Ther. Oct. 26, 2015(10):688-97.
Nambiar B, et al. Characteristics of minimally oversized adeno-associated virus vectors encoding human Factor VIII generated using producer cell lines and triple transfection. Hum Gene Ther Methods. Feb. 2017;28(1):23-38.
Pacouret S, et al. AAV-ID: A Rapid and Robust Assay for Batch-to-Batch Consistency Evaluation of AAV Preparations. Mol Ther. Apr. 17, 2017. Epub ahead of print.
Penaud-Budloo M, et al. Accurate identification and quantification of DNA species by next-generation sequencing in adeno-associated viral vectors produced in insect cells. Hum Gene Ther Methods. May 2, 2017. Epub ahead of print.
Ruffing M, et al. Assembly of viruslike particles by recombinant structural proteins of adeno-associated virus type 2 in insect cells. J Virol. Dec. 1992;66(12):6922-30.
Samulski RJ, et al. Helper-free stocks of recombinant adeno-associated viruses: normal integration does not require viral gene expression. J Virol. Sep. 1989;63(9):3822-8.
Smith RH, et al. A simplified baculovirus-AAV expression vector system coupled with one-step affinity purification yields high-titer rAAV stocks from insect cells. Mol Ther. Nov. 2009;17(11):1888-96. doi: 10.1038/mt.2009.128. Epub Jun. 16, 2009.
Urabe M, et al. Scalable generation of high-titer recombinant adeno-associated virus type 5 in insect cells. J Virol. Feb. 2006;80(4):1874-85.
Van Der Loo JCM, et al. Progress and challenges in viral vector manufacturing. Hum Mol Genet. Apr. 2016;25(R1): R42-52.
Wasilko DJ, et al. The titerless infected-cells preservation and scale-up (TIPS) method for large-scale production of NO-sensitive human soluble guanylate cyclase (sGC) from insect cells infected with recombinant baculovirus. Protein Expr Purif. Jun. 2009;65(2):122-32. doi: 10.1016/j.pep.2009.01.002. Epub Jan. 11, 2009.
Zhao KN, et al. BPV1 E2 protein enhances packaging of full-length plasmid DNA in BPV1 pseudovirions. Virology. Jul. 5, 2000;272(2):382-93.
Pierson EE, et al. Resolving adeno-associated viral particle diversity with charge detection mass spectrometry. Anal Chem. Jul. 2016;88(13):6718-25.
Rashnonejad A, et al. Large-Scale Production of Adeno-Associated Viral Vector Serotype-9 Carrying the Human Survival Motor Neuron Gene. Mol Biotechnol. Jan. 2016;58(1):30-6.
Ling C, et al. Strategies to generate high-titer, high-potency recombinant AAV3 serotype vectors. Mol Ther Methods Clin Dev. May 2016;3:16029.
Afione S, et al. Identification and Mutagenesis of the Adeno-Associated Virus 5 Sialic Acid Binding Region.J Virol. Feb. 2015, 89(3):1660-72.
Drouin LM, et al. Cryo-electron microscopy reconstruction and stability studies of Wild-Type and R432A Variant of AAV2 Reveals Capsid Structural Stability is a Major Factor in Genome Packaging. J Virol. Sep. 2016;90(19):8542-51.
Halder S, et al. Structure of neurotropic adeno-associated virus AAVrh.8. J Struct Biol. Oct. 2015;192(1):21-36.
Huang LY, et al. Characterization of the adeno-associated virus 1 and 6 sialic acid binding site. J Virol. May 2016;90(11):5219-30.
Mao Y, et al. Single point mutation in adeno-associated viral vectors—DJ capsid leads to improvement for gene delivery in vivo. BMC Biotechnol. Jan. 2016;16:1.
Marsic D et al. Altering Tropism of rAAV by Directed Evolution. Methods of Mol Biol. 2016;1382:151-73.
Tu MY, et al. Role of capsid proteins in parvoviruses infection. Virol J. Aug. 2015, 4;12:114.
Zeng C, et al. Probing the Link between Genomic Cargo, Contact Mechanics and Nanoindentation in Recombinant Adeno-Associated Virus 2. J Phys Chem B. Mar. 2017;121(8):1843-1853.
Zinn E, et al. In Silico Reconstruction of the Viral Evolutionary Lineage Yields a Potent Gene Therapy Vector. Cell Rep. Aug. 2015, 12(6):1056-68.
Grimm D, et al. E Pluribus Unum: 50 years of research, millions of viruses and one goal—tailored acceleration of AAV evolution. Mol Ther. Dec. 2015;23(12):1819-1831.
Karamuthil-Melethil S, et al. Novel Vector Design and Hexosaminidase Variant Enabling Self-Complementary Adeno-Associated Virus for the Treatment of Tay-Sachs Disease. Hum Gene Ther. Jul. 2016;27(7):509-21.
Ling C, et al. Development of Optimized AAV Serotype Vectors for High-Efficiency Transduction at Further Reduced Doses. Hum Gene Ther Methods. Aug. 2016;27(4):143-9.
Pillay S, et al. An essential receptor for adeno-associated virus infection. Nature. Feb. 2016;530(7588):108-12.

(56) References Cited

OTHER PUBLICATIONS

Li BZ, et al. Site directed mutagenesis of surface-exposed lysine residues leads to improved transduction by AAV2 but not AAV8 vectors in murine hepatocytes in vivo. Hum Gene Ther Methods. Dec. 2015;26(6):211-20.
Shen S, et al. Functional Analysis of the Putative Integrin Recognition Motif on Adeno-associated virus 9. J Biol Chem. Jan. 2015, 290(3):1496-504.
Steines B, et al. CFTR gene transfer with AAV improves early cystic fibrosis pig phenotypes. JCI Insight. Sep. 2016;1(14):e88728.
Bensky MJ, et al. Targeted gene delivery to the enteric nervous system using AAV: a comparison across serotypes and capsid mutants.Mol Ther. Mar. 2015;23(3):488-500.
Castle MJ, et al. Controlling AAV Tropism in the Nervous System with Natural and Engineered Capsids. Methods Mol Biol. 2016;1382:133-49.
Choudhury SR, et al. Widespread CNS gene transfer and silencing after systemic delivery of novel AAV-AS vectors. Mol Ther. Apr. 2016;24(4):726-35.
Davis AS, et al. Rational design and engineering of a modified adeno-associated virus (AAV1)-based vector system for enhanced retrograde gene delivery. Neurosurgery. Feb. 2015;76(2):216-25.
Deverman BE et al. Cre-dependent selection yields AAV variants for widespread gene transfer to the adult brain. Nat Biotechnol. Feb. 2016;34(2):204-9.
Powell SK et al. Characterization of a novel adeno-associated viral vector with preferential oligodendrocyte tropism. Gene Ther. Sep. 15, 2016.
Tervo et al. A Designer AAV Variant Permits Efficient Retrograde Access to Projection Neurons. Neuron. Oct. 19, 2016;92(2):372-382.
Choudhury et al. In Vivo Selection Yields AAV-B1 Capsid for Central Nervous System and Muscle Gene Therapy. Mol Ther. Aug. 2016;24(7):1247-57.
Keravala A, et al. Evaluating AAV Hybrid Variants for Improved Tropism after Intravitreal Gene Delivery to the Retina. Molecular Therapy, vol. 23, Supplement 1, May 2015, pp. S127-S128.
Vercauteren K, et al. Superior in vivo Transduction of Human Hepatocytes Using Engineered AAV3 Capsid. Mol Ther. Jun. 2016;24(6):1042-9.
Chen M, et al. Efficient Gene Delivery and Expression in Pancreas and Pancreatic Tumors by Capsid-optimized AAV8 Vectors. Hum Gene Ther Methods. Feb. 2017;28(1):49-59.
Ling C, et al. High-Efficiency Transduction of Primary Human Hematopoietic Stem/Progenitor Cells by AAV6 Vectors: Strategies for Overcoming Donor-Variation and Implications in Genome Editing. Sci Rep. Oct. 2016;6:35495.
Earley LF, et al. Identification and Characterization of Nuclear and Nucleolar Localization Signals in the Adeno-Associated Virus Serotype 2 Assembly-Activating Protein. J Virol. Mar. 2015, 89(6):3038-48.
Zou W, et al. Nonstructural protein NP1 of human bocavirus 1 plays a critical role in the expression of viral capsid proteins. J Virol. Apr. 2016;90(9):4658-69.
Mingozzi F, et al. Adeno-associated viral vectors at the frontier between tolerance and immunity. Front Immunol.Mar. 2015, 6:120.
Ling C, et al. Enhanced Transgene Expression from Recombinant Single-Stranded D-Sequence-Substituted Adeno-Associated Virus Vectors in Human Cell Lines In Vitro and in Murine Hepatocytes In Vivo. J Virol. Jan. 2015, 89(2):952-61.
Xie J, et al. Short DNA Hairpins Compromise Recombinant Adeno-Associated Virus Genome Homogeneity. Mol Ther. Apr. 24, 2017. Epub ahead of print.
Davidsson M, et al. A novel process of viral vector barcoding and library preparation enables high-diversity library generation and recombination-free paired-end sequencing. Sci Rep. Nov. 2016;6:3563.
Chamberlain K, et al. Expressing transgenes that exceed the packaging capacity of AAV capsids. Hum Gene Ther Methods. Feb. 2016;27(1):1-12.
De Leeuw CN et al. rAAV-compatible MiniPromoters for Restricted Expression in the Brain and Eye. Mol Brain. May 10, 2016;9(1):52.

Nicolson SC, et al. Identification and validation of small molecules that enhance recombinant Adeno-associated virus transduction following high throughput screen. J Virol. Jul. 2016;90(16):7019-31.
Wang M, et al. Direct interaction of human serum proteins with AAV virions to enhance AAV transduction: Immediate impact on clinical applications. Gene Ther. Jan. 2017;24(1):49-59.
Watakabe A, et al. Comparative analyses of adeno-associated viral vector serotypes 1 2 5 8 and 9 in marmoset mouse and macaque cerebral cortex. Neurosci Res.Apr. 2015, 93:144-57.
Xiao P, et al. Disruption of microtubules post virus entry enhances adeno-associated virus vector transduction. Hum Gene Ther. Apr. 2016;27(4):309-24.
Hudry EM, et al. Exosome-associated AAV vector as a robust and convenient neurosocience tool. Gene Ther. Apr. 2016;23(4):380-92.
Nery FC, et al. New methods for investigation of neuronal migration in embryonic brain explants J Neurosci Methods.Jan. 2015, 239:80-4.
Su W et al. Recombinant adeno-associated viral (rAAV) vectors mediate efficient gene transduction in cultured neonatal and adult microglia. J Neurochem. Jan. 2016;136 Suppl 1:49-62.
Ren XF, et al. Adeno-associated virus-mediated BMP-7 and SOX9 in vitro co-transfection of human degenerative intervertebral disc cells. Genet Mol Res. Apr. 22, 2015;14(2):3736-44.
Alves S et al. Ultramicroscopy as a Novel Tool to Unravel the Tropism of AAV Gene Therapy Vectors in the Brain. Sci Rep. Jun. 20, 2016;6:28272.
Kothari P, et al. Radioiodinated Capsids Facilitate In Vivo Non-Invasive Tracking of Adeno-Associated Gene Transfer Vectors. Sci Rep. Jan. 2017;7:39594.
Xie Q, et al. The 2.8 Å Electron Microscopy Structure of Adeno-Associated Virus-DJ Bound by a Heparinoid Pentasaccharide. Mol Ther Methods Clin Dev. Mar. 8, 2017;5:1-12.
Srivastava A. Adeno-Associated Virus: The Naturally Occurring Virus Versus the Recombinant Vector. Hum Gene Ther. Jan. 2016;27(1):1-6.
Thorne B, et al. Gene Therapy. Adv Biochem Eng Biotechnol. Mar. 14, 2017 Epub ahead of print.
Tratschin JD, et al. Adeno-associated virus vector for high-frequency integration, expression, and rescue of genes in mammalian cells. Mol Cell Biol. Nov. 1985;5(11):3251-60.
Srivastava A, et al. Nucleotide sequence and organization of the adeno-associated virus 2 genome. J Virol. Feb. 1983;45(2):555-64.
Summerford C, et al. AAVR: A multi-serotype receptor for AAV. Mol Ther. Apr. 2016;24(4):663-6.
Xie Q, et al. The atomic structure of adeno-associated virus (AAV-2), a vector for human gene therapy. Proc Natl Acad Sci U S A. Aug. 6, 2002;99(16):10405-10. Epub Jul. 22, 2002.
Wu P, et al. Mutational analysis of the adeno-associated virus type 2 (AAV2) capsid gene and construction of AAV2 vectors with altered tropism. J Virol. Sep. 2000;74(18):8635-47.
Von Heinje G. Sequence Analysis in Molecular Biology. Academic Press, 1987.
Stahl PH, et al. Pharmaceutical Salts: Properties, Selection, and Use. Wiley-VCH, 2008.
Yang C, et al. Sequential adeno-associated viral vector serotype 9-green fluorescent protein gene transfer causes massive inflammation and intense immune response in rat striatum. Hum Gene Ther. Jul. 2016;27(7):528-43.
Chandler RJ, et al. rAAV integration and genotoxicity: insights from animal models. Hum Gene Ther. Apr. 2017;28(4):314-322.
Ye L., et al. Adeno-Associated Virus Vector Mediated Delivery of the HBV Genome Induces Chronic Hepatitis B Virus Infection and Liver Fibrosis in Mice. PLoS One. Jun. 2015, 10(6):e0130052.
Wang S, et al. Direct brain infusion can be enhanced with focused ultrasound and microbubbles. J Cereb Blood Flow Metab. Feb. 2017;37(2):706-714.
Wang et al., Noninvasive, neuron-specific gene therapy can be facilitated by focused ultrasound and recombinant adeno-associated virus. Gene Therapy. Nov. 22, 2014, 104-110.
Weber-Adrian D, et al. Gene delivery to the spinal cord using MRI-guided focused ultrasound. Gene Ther. Jul. 2015, 22(7):568-77.

(56) References Cited

OTHER PUBLICATIONS

Wu D et al. Expressing Constitutively Active Rheb in Adult Dorsal Root Ganglion Neurons Enhances the Integration of Sensory Axons that Regenerate Across a Chondroitinase-Treated Dorsal Root Entry Zone Following Dorsal Root Crush. Front Mol Neurosci. Jul. 5, 2016;9:49.
Zhu W, et al. Soluble FLT1 Gene Therapy Alleviates Brain Arteriovenous Malformation Severity. Stroke. May 2017;48(5):1420-1423.
Watson ZL, et al. Adeno-associated Virus Vectors Efficiently Transduce Mouse and Rabbit Sensory Neurons Coinfected with Herpes Simplex Virus 1 following Peripheral Inoculation. J Virol. Aug. 12, 2016;90(17):7894-901.
Suzuki J, et al. Cochlear gene therapy with ancestral AAV in adult mice: complete transduction of inner hair cells without cochlear dysfunction. Apr. 3, 2017;7:45524.
Woodard KT et al. Heparan Sulfate Binding Promotes Accumulation of Intravitreally Delivered Adeno-associated Viral Vectors at the Retina for Enhanced Transduction but Weakly Influences Tropism. J Virol. Oct. 14, 2016;90(21):9878-9888.
Wang LL, et al. Comparative study of liver gene transfer with AAV vectors based on endogenous and engineered AAV capsids. Mol Ther. Dec. 2015;23(12):1877-87.
Sondhi D, et al. Genetic Modification of the Lung Directed Toward Treatment of Human Disease. Hum Gene Ther. Jan. 2017;28(1):3-84.
Yalvac ME, et al. AAV1.NT-3 gene therapy attenuates spontaneous autoimmune peripheral polyneuropathy. Gene Ther. Jan. 2016;23(1):95-102.
Srivastava A. In Vivo Tissue-tropism of Adeno-associated Viral Vectors. Curr Opin Virol. Sep. 2, 2016;21:75-80.
Adamson-Small L, et al. Sodium chloride enhances rAAV production in a serum-free suspension manufacturing platform using the Herpes Simplex Virus System. Hum Gene Ther Methods. Feb. 2017;28(1):1-14.
Ai J, et al. A Scalable and Accurate Method for Quantifying Vector Genomes of Recombinant Adeno-Associated Viruses in Crude Lysate. Hum Gene Ther Methods. Apr. 13, 2017. Epub ahead of print.
Buclez PO, et al. Rapid, scalable, and low-cost purification of recombinant adeno-associated virus produced by baculovirus expression vector system. Mol Ther Methods Clin Dev. May 2016;3:16035.
Burnham B, et al. Analytical ultracentrifugation as an approach to characterize recombinant adeno-associated viral vectors. Hum Gene Ther Methods. Dec. 2015;26(6):228-42.
Clement N, et al. Manufacturing of recombinant adeno-associated viral vectors for clinical trials. Mol Ther Methods Clin Dev. Mar. 2016;3:16002.
D'Costa S, et al. Practical utilization of recombinant AAV vector reference standards: focus on vector genome titration by free ITR qPCR. Mol Ther Methods Clin Dev. Mar. 2016;5:16019.
Grieger JC, et al. Production of Recombinant Adeno-associated Virus Vectors Using Suspension HEK293 Cells and Continuous Harvest of Vector From the Culture Media for GMP FIX and FLT1 Clinical Vector. Mol Ther. Feb. 2016;24 (2):287-97.
Gruntman AM, et al. Stability and Compatibility of Recombinant Adeno-Associated Virus Under Conditions Commonly Encountered in Human Gene Therapy Trials. Hum Gene Ther Methods. Apr. 2015, 26(2):71-6.
Kajigaya S, et al. Self-assembled B19 parvovirus capsids, produced in a baculovirus system, are antigenically and immunogenically similar to native virions. Proc Natl Acad Sci U S A. Jun. 1, 1991;88(11):4646-50.
Kirnbauer R, et al. Virus-like particles of bovine papillomavirus type 4 in prophylactic and therapeutic immunization. Virology. May 1, 1996;219(1):37-44.
Kohlbrenner E, et al. Production and Characterization of Vectors Based on the Cardiotropic AAV Serotype 9. Methods Mol Biol. 2017;1521:91-107.
Kotin RM, et al. Large-scale recombinant adeno-associated virus production. Hum Mol Genet. Apr. 15, 2011;20(R1): R2-6. doi: 10.1093/hmg/ddr141. Epub Apr. 29, 2011.
Kotin RM, et al. Manufacturing clinical grade recombinant adeno-associated virus using invertebrate cell lines. Hum Gene Ther. Mar. 28, 2017. Epub ahead of print.
Kotterman MA, et al. Enhanced cellular secretion of AAV2 by expression of foreign viral envelope proteins. Biochemical Engineering Journal, vol. 93, Jan. 15, 2015, pp. 108-114.
Mietzsch M, et al. OneBac 2.0: Sf9 Cell Lines for Production of AAV1, AAV2 and AAV8 Vectors with Minimal Encapsidation of Foreign DNA. Hum Gene Ther Methods. Feb. 2017;28(1):15-22.
Carter BJ. Adeno-associated virus and the development of adeno-associated virus vectors: a historical perspective. Mol Ther. Dec. 2004;10(6):981-9.
G. S. Banker, Modern Pharmaceutics, Drugs and the Pharmaceutical Sciences, v. 72, Marcel Dekker, New York, Inc., 1996.
Grimm D, et al. Progress in adeno-associated virus type 2 vector production: promises and prospects for clinical use. Hum Gene Ther. Oct. 10, 1999;10(15):2445-50.
Grimson A, et al. MicroRNA targeting specificity in mammals: determinants beyond seed pairing. Mol Cell. Jul. 6, 2007;27(1):91-105.
Hastie E, et al. Adeno-Associated Virus at 50: A Golden Anniversary of Discovery, Research, and Gene Therapy Success—A Personal Perspective. Hum Gene Ther. May 2015, 26(5):257-65.
Aydemir F, et al. Mutants at the 2-fold interface of AAV2 structural proteins suggest a role in viral transcription for AAV capsids. J Virol. Jul. 2016;90(16):7196-204.
Bantel-Schaal U, et al. Human adeno-associated virus type 5 is only distantly related to other known primate helper-dependent parvoviruses. J Virol. Feb. 1999;73(2):939-47.
Berry GE, et al. Cellular transduction mechanisms of adeno-associated viral vectors. Curr Opin Virol. Dec. 2016;21:54-60.
Chiorini JA, et al. Adeno-associated virus (AAV) type 5 Rep protein cleaves a unique terminal resolution site compared with other AAV serotypes. J Virol. May 1999;73(5):4293-8.
Chiorini JA, et al. Cloning and characterization of adeno-associated virus type 5. J Virol. Feb. 1999;73(2):1309-19.
Chiorini JA, et al. Cloning of adeno-associated virus type 4 (AAV4) and generation of recombinant AAV4 particles. J Virol. Sep. 1997;71(9):6823-33.
Earley LF, et al. Adeno-Associated Virus Assembly-Activating Protein Is Not an Essential Requirement for Capsid Assembly of AAV Serotypes 4, 5 and 11. J Virol. Jan. 2017;91(3):pii:e0198-16.
Ding C, et al., Biochemical Characterization of Junonia Coenia Densovirus Nonstructural Protein NS-1. J. Virol., 76(1):338-345 2002.
Adachi K, et al. Drawing a high-resolution functional map of adeno-associated virus capsid by massively parallel sequencing. Nat Commun. 2014;5:3075. doi: 10.1038/ncomms4075.
Altschul SF, et al. Basic local alignment search tool. J Mol Biol. Oct. 5, 1990;5;215(3):403-10.
Carillo H, et al. The Multiple Sequence Alignment Problem in Biology. SIAM J. Appl. Math. 48-5 (1988), pp. 1073-1082.
Devereux J A comprehensive set of sequence analysis programs for the VAX. Nucleic Acids Res. Jan. 11, 1984;12(1 Pt 1):387-95.
Gribskov M, et al. Sequence Analysis Primer. M Stockton Press, New York, 1991.
Griffin AM, et al. Computer Analysis of Sequence Data, Part I. Humana Press, New Jersey, 1994.
Berge SM Pharmaceutical salts. J Pharm Sci. Jan. 1977;66(1):1-19.
Bell P, et al. Effects of self-complementarity, codon optimization, transgene, and dose on liver transduction with AAV8. Hum Gene Ther Methods. Dec. 2016;27(6):228-237.
Heim et al., Wavelength mutations and posttranslational autoxidation of green fluorescent protein. Proc. Natl. Acad. Sci. USA (1994).
Hastie E, et al. Recombinant adeno-associated virus vectors in the treatment of rare diseases. Expert Opin Orphan Drugs. 2015;3(6):675-689.
Fargnoli AS, et al. Liquid jet delivery method featuring S100A1 gene therapy in the rodent model following acute myocardial infarction. Gene Ther. Feb. 2016;23(2):151-7.

(56) References Cited

OTHER PUBLICATIONS

Aubourg P. Gene therapy for rare central nervous system diseases comes to age. Endocr Dev. 2016;30:141-6.
Bankiewicz KS et al. AAV Viral Vector Delivery to the Brain by Shape-conforming MR-guided Infusions. J Control Release. Oct. 28, 2016;240:434-442.
Bey K, et al. Efficient CNS targeting in adult mice by intrathecal infusion of single-stranded AAV9-GFP for gene therapy of neurological disorders. Gene Ther. Apr. 20, 2017. Epub ahead of print.
Brulet R, et al. NEUROD1 Instructs Neuronal Conversion in Non-Reactive Astrocytes. Stem Cell Reports. May 11, 2017. Epub ahead of print.
Cabral-Miranda F, et al. rAAV8-733-Mediated Gene Transfer of CHIP/Stub-1 Prevents Hippocampal Neuronal Death in Experimental Brain Ischemia. Mol Ther. Feb. 2017;25(2):392-400.
Chandler RJ, et al. Systemic AAV9 gene therapy improves the lifespan of mice with Niemann-Pick disease, type C1. Hum Mol Genet. Jan. 2017;26(1):52-64.
Dang CH, et al. In vivo dynamics of AAV-mediated gene delivery to sensory neurons of the trigeminal ganglia. Sci Rep. Apr. 19, 2017;7(1):927.
Dimidschstein J, et al. A viral strategy for targeting and manipulating interneurons across vertebrate species. Nat Neurosci. Dec. 2016;19(12):1743-1749.
Donsante A et al. Intracerebroventricular delivery of self-complementary adeno-associated virus serotype 9 to the adult rat brain. Gene Ther. May 2016;23(5):401-7.
El-Shamayleh Y, et al. Strategies for targeting primate neural circuits with viral vectors. J Neurophysiol. Jul. 2016;116(1):122-34.
Foust KD, et al. Intravascular AAV9 preferentially targets neonatal neurons and adult astrocytes. Nat Biotechnol. Jan. 2009;27(1):59-65. doi: 10.1038/nbt.1515. Epub Dec. 21, 2008.
Gessler DJ et al. Gene Therapy for the Treatment of Neurological Disorders: Metabolic Disorders. Methods Mol Biol. 2016;1382:429-65.
Gilkes JA et al. Preferred Transduction with AAV8 and AAV9 via Thalamic Administration in the MPS IIIB Model: A Comparison of Four rAAV Serotypes. Mol Genet Metab Rep. Dec. 7, 2015;6:48-54.
Gombash SE, et al. Systemic Gene Therapy for Targeting the CNS. Methods Mol Biol. 2016;1382:231-7.
Gurda BL, et al. Evaluation of AAV-mediated gene therapy for central nervous system disease in canine mucopolysaccharidosis VII. Mol Ther. Feb. 2016;24(2):206-16.
Ahmed SS, et al. rAAV gene therapy in a Canavan's disease mouse model reveals immune impairments and an extended pathology beyond the central nervous system. Mol Ther. Jun. 2016;24(6):1030-41.
Dashkoff J, et al. Tailored transgene expression to specific cell types in the central nervous system after peripheral injection with AAV9. Mol Ther Methods Clin Dev. Dec. 2016;3:16081.
Gruntman AM, et al. Retro-Orbital Venous Sinus Delivery of rAAV9 Mediates High-Level Transduction of Brain and Retina Compared with Temporal Vein Delivery in Neonatal Mouse Pups. Hum Gene Ther. Mar. 2017;28(3):228-230.
Aoyama Y, et al. Wnt11 gene therapy with adeno-associated virus 9 improves the survival of mice with myocarditis induced by coxsackievirus B3 through the suppression of the inflammatory reaction. J Mol Cell Cardiol. Jul. 2015;84:45-51.
Greig JA, et al. Impact of intravenous infusion time on AAV8 vector pharmacokinetics, safety, and liver transduction in cynomolgus macaques. Mol Ther Methods Clin Dev. Dec. 2016;3:16079.
Gruntman AM, et al. Delivery of Adeno-associated virus gene therapy by intravascular limb infusion methods. Hum Gene Ther Clin Dev Sep. 2015;26(3):159-64.
Hagg A, et al. Using AAV vectors expressing the beta 2-adrenoceptor or associated G alpha proteins to modulate skeletal muscle mass and muscle fiber size. Sci Rep. Mar. 2016;6:23042.
Greig JA, et al. Intramuscular administration of AAV overcomes pre-existing neutralizing antibodies in rhesus macaques. Vaccine. Dec. 2016;34(50):6323-6329.

Ai J, et al. Adeno-associated virus serotype rh.10 displays strong muscle tropism following intraperitoneal delivery. Sci Rep. Jan. 2017;7:40336.
Baum BJ, et al. Advances in salivary gland gene therapy—oral and systemic implications. Expert Opinion on Biological Therapy. 2015;15(10):1443-54.
Hai B, et al. Long-term transduction of miniature pig parotid glands using serotype 2 adeno-associated viral vectors. J Gene Med. Jun. 2009;11(6):506-14.
Maniatis T. et al.,Molecular Cloning. CSH Laboratory, NY, N.Y. (1982).
Merten OW, et al. Viral vectors for gene therapy and gene modification approaches. Biochem Eng J. Apr. 2016;108:98-115.
Muzyczka N, et al. AAV's Golden Jubilee. Mol Ther. May 2015;23(5):807-8.
Philiport, et al. Liposomes as tools in Basic Research and Industry. CRC Press, Ann Arbor, Mich. (1995).
Kailasan S, et al. Parvovirus Family Conundrum: What makes a killer? Annu Rev Virol. Nov. 2015;2(1):425-50.
Rutledge EA, et al. Infectious clones and vectors derived from adeno-associated virus (AAV) serotypes other than AAV type 2. J Virol. Jan. 1998;72(1):309-19.
Pillay S, et al. An essential receptor for adeno-associated virus infection. Nature. Nov. 17, 2016;539(7629):456.
Platt MP, et al. Embryonic disruption of the candidate dyslexia susceptibility gene homolog Kiaa0319-like results in neuronal migration disorders. Neuroscience. Sep. 17, 2013;248:585-93.
Poon MW, et al. Distribution of Kiaa0319-like immunoreactivity in the adult mouse brain—a novel protein encoded by the putative dyslexia susceptibility gene KIAA0319-like. Histol Histopathol. Aug. 2011;26(8):953-63.
Poon MW, et al. Dyslexia-associated kiaa0319-like protein interacts with axon guidance receptor nogo receptor 1. Cell Mol Neurobiol. Jan. 2011;31(1):27-35.
Myers EW, et al. Optimal alignments in linear space. Comput Appl Biosci. Mar. 1988;4(1):11-7.
Smith DW, et al. Biocomputing: Informatics and Genome Projects. Academic Press, New York, 1993.
Kozak M. Interpreting cDNA sequences: some insights from studies on translation. Mamm Genome. Aug. 1996;7(8):563-74.
Kozak M. Point mutations define a sequence flanking the AUG initiator codon that modulates translation by eukaryotic ribosomes. Cell. Jan. 31, 1986;44(2):283-92.
Kozak M. The scanning model for translation: an update. J Cell Biol. Feb. 1989;108(2):229-41.
Heim R, et al. Engineering green fluorescent protein for improved brightness, longer wavelengths and fluorescence resonance energy transfer. Curr Biol. Feb. 1, 1996;6(2):178-82.
Heim R,et al. Improved green fluorescence Nature 373, 663-664 (Feb. 23, 1995); doi:10.1038/373663b0.
Nygaard S, et al. A universal system to select gene-modified hepatocytes in vivo. Sci Transl Med. Jun. 2016;8(342):342ra79.
Smith RH, et al. Germline viral "fossils" guide in silico reconstruction of a mid-Cenozoic era marsupial adeno-associated virus. Sci Rep. Jul. 2016;6:28965.
Li L, et al. Production and characterization of novel recombinant adeno-associated virus replicative-form genomes: a eukaryotic source of DNA for gene transfer. PLoS One. Aug. 1, 2013;8(8):e69879. doi: 10.1371/journal.pone.0069879. Print 2013.
O'Reilly DR, et al. Baculovirus expression vectors: a laboratory manual. Oxford University Press, 1994.
Oliva B, et al. An automated classification of the structure of protein loops. J Mol Biol. Mar. 7, 1997;266(4):814-30.
Samaranch L, et al. MR-guided parenchymal delivery of adeno-associated viral vector serotype 5 in non-human primate brain. Gene Ther. Apr. 2017;24(4):253-261.
Petit L, et al. Rod Outer Segment Development Influences AAV-Mediated Photoreceptor Transduction After Subretinal Injection. Hum Gene Ther. May 16, 2017. Epub ahead of print.
Hinderer C et al. Delivery of an Adeno-Associated Virus Vector into CSF Attenuates Central Nervous Sytem Disease in Mucopolysaccharidosis Type II Mice. Hum Gene Ther. Aug. 10, 2016.

(56) References Cited

OTHER PUBLICATIONS

Hordeaux J., et al. Efficient central nervous system AAVrh10-mediated intrathecal gene transfers in adult and neonate rats. Gene Ther.Apr. 2015, 22(4):316-24.
Merkel SF et al. Trafficking of AAV Vectors Across a Model of the Blood-Brain Barrier; a Comaparative Study of Transcytosis and Transduction Using Primary Human Brain Endothelial Cells. J Neurochem. Oct. 8, 2016.
Miyanohara A et al. Potent Spinal Parenchymal AAV9-mediated Gene Delivery by Subpial Injection in Adult Rats and Pigs. Mol Ther Methods Clin Dev. Jul. 13, 2016;3:16046.
Muralidharan G , et al. Unique glycan signatures regulate adeno-associated virus tropism in the developing brain. J Virol. Apr. 2015;89(7):3976-87.
Ponder K, et al. Intrathecal injection of lentiviral vector results in high expression in the brain of mucopolysaccharidosis VII dogs but the pattern of expression is different than for AAV9 or AAV-rh10. J Control Release. Dec. 2014, 196:71-8.
Salegio EA, et al. MRI-Guided Delivery of Viral Vectors. Methods Mol Viol. 2016;1382:217-30.
Samaranch L et al. Cerebellomedullary Cistern Delivery for AAV-Based Gene Therapy: A Technical Note for Nonhuman Primates. Hum Gene Ther Methods. Feb. 2016;27(1):13-6.
Saraiva J et al. Gene Therapy for the CNS Using AAVs: The Impact of Systemic Delivery by AAV9. J Control Release. Nov. 10, 2016;241:94-109.
Shen F, et al. Inhibition of pathological brain angiogenesis through systemic delivery of AAV vector expressing soluble FLT1. Gene Therapy. Nov. 22, 2015:893-900.
Hinderer C, et al. Neonatal Systemic AAV Induces Tolerance to CNS Gene Therapy in MPS I Dogs and Nonhuman Primates. Mol Ther. Aug. 2015, 23(8):1298-307.
Ojala DS, et al. Adeno-associated virus vectors and neurological gene therapy. Neuroscientist. Feb. 2015;21(1):84-98.
Katz ML, et al. AAV gene transfer delays disease onset in a TPP1-deficient canine model of the late infantile form of Batten Disease. Sci Transl Med. Nov. 2015;7(313):313ra180.
Kothari P, et al. Iodine-124 Labeled Adeno-Associated Virus: A Promising Tool for Tracking Gene Therapy. Journal of Nuclear Medicine. May 2015, 56 (supplement 3), 494-494.
Landegger LD, et al. A synthetic AAV vector enables safe and efficient gene transfer to the mammalian inner ear. Nat Biotechnol. Mar. 2017;35(3):280-284.
Mason JB, et al. Delivery and evaluation of recombinant adeno-associated viral vectors in the equine distal extremity for the treatment of laminitis. Equine Vet J. Jan. 2017;49(1):79-86.
Jeong D, et al. Matricellular Protein CCN5 Reverses Established Cardiac Fibrosis. J Am Coll Cardiol. Apr. 5, 2016;67(13):1556-68.
Knezevic T, et al. Adeno-associated Virus Serotype 9—Driven Expression of BAG3 Improves Left Ventricular Function in Murine Hearts with Left Ventricular Dysfunction Secondary to a Myocardial Infarction. JACC Basic Transl Sci. Dec. 2016; 1(7):647-656.
Ibrahim S, et al. Stable liver specific expression of human IDOL in humanized mice raises plasma cholesterol. Cardiovasc Res. May 2016;110(1):23-9.
Li SY, et al. Efficient and targeted transduction of nonhuman primate liver with systemically delivered optimized AAV3B vectors. Mol Ther. Dec. 2015;23(12):1867-76.
Heller KN, et al. Human alpha 7 integrin gene (ITGA7) delivered by adeno-associated virus extends survival of severely affected dystrophin/utrophin deficient mice. Oct. 2015;26(10):647-56.
Mendell JR, et al. Follistatin Gene Therapy for Sporadic Inclusion Body Myositis Improves Functional Outcomes. Mol Ther. Apr. 2017;25(4):870-879.
Schnepp BC, et al. Recombinant adeno-associated virus vector genomes take the form of long-lived transcriptionally competent episomes in human muscle. Hum Gene Ther. Jan. 2016;27(1):32-42.
Murlidharan G et al. Glymphatic Fluid Transport Controls Paravascular Clearance of AAV Vectors from the Brain. JCI Insight. Sep. 8, 2016;1(14).
Neuberger EWI, et al. Establishment of two quantitative nested qPCR assays targeting the human EPO transgene. Gene Ther. Apr. 2016;23(4):330-9.
Lentz TB, et al. Insight into the Mechanism of Inhibition of Adeno-Associated Virus by the Mre11/Rad50/Nbs1 Complex. J Virol. Jan. 2015, 89(1):181-94.
Hirsch ML, et al. Delivering Transgenic DNA Exceeding the Carrying Capacity of AAV Vectors. Methods Mol Biol. 2016;1382:21-39.
Lu J, et al. A 5'non-coding exon containing engineered intron enhances transgene expression from recombinant AAV vectors in vivo. Hum Gene Ther. Jan. 2017;28(1):125-134.
Powell SK, et al. Viral expression cassette elements to enhance transgene target specificity and expression in gene therapy. Discov Med. Jan. 2015;19(102):49-57.
Rosario AM et al. Microglia-specific Targeting by Novel Capsid-modified AAV6 Vectors. Mol Ther Methods Clin Dev. Apr. 13, 2016;3:16026.
Wang L, et al. Productive life cycle of adeno-associated virus serotype 2 in the complete absence of a conventional polyadenylation signal. J Gen Virol. Sep. 2015;96(9):2780-7.
Yan ZY, et al. Optimization of recombinant adeno-associated virus mediated expression for large transgenes, using a synthetic promoter and tandem array enhancers. Hum Gene Ther. Jun. 2015;26(6):334-46.
Jackson KL, et al. Better Targeting, Better Efficiency for Wide-Scale Neuronal Transduction with the Synapsin Promoter and AAV-PHP. B. Front Mol Neurosci. Nov. 2016;6:116.
McClements ME, et al. A fragmented adeno-associated viral dual vector strategy for treatment of diseases caused by mutations in large genes leads to expression of hybrid transcripts. J Genet Syndr Gene Ther. Nov. 2016;7(5):311.
Parr MJ, et al. Tumor-selective transgene expression in vivo mediated by an E2F-responsive adenoviral vector. Nat Med. Oct. 1997;3(10):1145-9.
Reid CA, et al. miRNA mediated post-transcriptional silencing of transgenes leads to increased adeno-associated viral vector yield and targeting specificity. Gene Ther. Jun. 15, 2017. Epub ahead of print.
Sawada Y et al. Inflammation-induced Reversible Switch of the Neuron-specific Enolase Promoter from Purkinje Neurons to Bergmann Glia. Sci Rep. Jun. 13, 2016;6:27758.
Lukashcuk V et al. AAV9-mediated central nervous system-targeted gene delivery via cisterna magna route in mice. Mol Ther Methods Clin Dev. Feb. 17, 2016;3:15055.
Tarantal AF, et al. Systemic and Persistent Muscle Gene Expression in Rhesus Monkeys with a Liver De-targeted Adeno-Associated Virus (AAV) Vector. Hum Gene Ther. May 2017;28(5):385-391.
Huang LY, et al. Characterization of the Adeno-Associated Virus 1 and 6 Sialic Acid Binding Site. J Virol. May 12, 2016;90(11):5219-30.
Siu JJ, et al. Improved gene delivery to adult mouse spinal cord through the use of engineered hybrid adeno-associated viral serotypes. Gene Ther. Apr. 25, 2017. Epub ahead of print.
Deng XF, et al. Replication of an autonomous human parvovirus in non-dividing human airway epithelium is facilitated through the DNA damage and repair pathways. PLoS Pathog. Jan. 2016;12(1):e1005399.
Kailasan S, et al. Structure of an Enteric Pathogen, Bovine Parvovirus.J Virol. Mar. 2015, 89(5):2603-14.
Alton EW, et al. Repeated nebulisation of non-viral CFTR gene therapy in patients with cystic fibrosis: a randomised, double-blind, placebo-controlled, phase 2b trial. Lancet Respir Med. Sep. 2015;3(9):684-91.
Baum BJ, et al. Early responses to adenoviral-mediated transfer of the aquaporin-1 cDNA for radiation-induced salivary hypofunction. Proc Natl Acad Sci U S A. Nov. 20, 2012;109(47):19403-7.
Shen W, et al. Analysis of the Cis and Trans Requirements for DNA Replication at the Right End Hairpin of the Human Bocavirus 1 Genome. J Virol. Aug. 2016;90(17):7761-77.

(56) References Cited

OTHER PUBLICATIONS

Tseng YS, et al. Adeno-Associated Virus Serotype 1 (AAV1)- and AAV5-Antibody Complex Structures Reveal Evolutionary Commonalities in Parvovirus Antigenic Reactivity. J Virol. Feb. 2015, 89(3)1794-808.
Samaranch L et al. Slow AAV2 Clearance from the Brain of Nonhuman Primates and Anti-capsid Immune Response. Gene Ther. Apr. 2016;23(4):393-8.
Tse LV, et al. Structure-guided evolution of antigenically distinct adeno-associated virus variants for immune evasion. Proc Natl Acad Sci U S A. May 30, 2017. Epub ahead of print.
Li CW, et al. Development of patient-specific AAV vectors after neutralizing antibody selection for enhanced muscle gene transfer. Mol Ther. Feb. 2016;24(1):53-65.
Zhao L et al. Intracerebral adeno-associated virus gene delivery of apolipoprotein E2 markedly reduces brain amyloid pathology in Alzheimer's disease mouse models. Neurobiol Aging. Aug. 2016;44:159-72.
Ren J, et al. Noninvasive tracking of gene transcript and neuroprotection after gene therapy. Gene Ther. Jan. 2016;23(1):1-9.
Murlidharan G et al. CNS-restricted Transduction and CRISPR/Cas9-mediated Gene Deletion with an Engineered AAV Vector. Mol Ther Nucleic Acids. Jul. 19, 2016;5(7):e33.
Hocquemiller M et al. Adeno-Associated Virus-Based Gene Therapy for CNS Diseases. Hum Gene Ther. Jul. 2016;27(7):478-96.
Marks WJ et al. Long-Term Safety of Patients with Parkinson's Disease Receiving rAAV2-Neurturin (CERE-120) Gene Transfer. Hum Gene Ther. Jul. 2016;27(7):522-7.
Olanow CW, et al. Gene delivery of neurturin to putamen and substantia nigra in Parkinson disease: A double-blind randomized controlled trial. Ann Neurol.Aug. 2015, 78(2):248-57.
Paul G, et al. Safety and tolerability of intracerebroventricular PDGF-BB in Parkinson's disease patients. J Clin Invest. Mar. 2, 2015;125(3):1339-46.
Morabito G, Giannelli SG, Ordazzo G, Bido S, Castoldi V, Indrigo M, Cabassi T, Cattaneo S, Luoni M, Cancellieri C, Sessa A, Bacigaluppi M, Taverna S, Leocani L, Lanciego JL, Broccoli V. Mol Ther. Dec. 6, 2017;25(12):2727-2742. Epub Aug. 10, 2017.
Matsuzaki Y, Konno A, Mochizuki R, Shinohara Y, Nitta K, Okada Y, Hirai H. Neurosci Lett. Nov. 23, 2017. [Epub ahead of print].
Dayton RD, et al. More expansive gene transfer to the rat CNS: AAV PHP.EB vector dose-response and comparison to AAV PHP.B. Gene Ther. Jul. 16, 2018 Epub ahead of print.
Naidoo J, et al. Extensive Transduction and Enhanced Spread of a Modified AAV2 Capsid in the Non-human Primate CNS. Mol Ther. Jul. 12, 2018 Epub ahead of print.
Giles AR, et al. Mapping an adeno-associated virus 9-specific neutralizing epitope to develop next-generation gene delivery vectors. J Virol. Aug. 8, 2018 Epub ahead of print.
Van Lieshout LP, et al. A Novel Triple-Mutant AAV6 Capsid Induces Rapid and Potent Transgene Expression in the Muscle and Respiratory Tract of Mice. Mol Ther Meth Clin Dev Jun. 15, 2018.
Tordo J, et al. A novel adeno-associated virus capsid with enhanced neurotropism corrects a lysosomal transmembrane enzyme deficiency. Brain Jul. 1, 2018;141(7):2014-2031.
Hudry E, et al. Efficient gene transfer to the central nervous system by single stranded Anc80L65. Mol Ther Meth Clin Dev. Jul. 15, 2018.
Tse LV, et al. Mapping and engineering function domains of the assembly-activating protein of adeno-associated viruses. J. Virol. Jun. 29, 2018;92(14).
Burg M, et al. Atomic structure of rationally engineered gene delivery vector, AAV2.5. Journal of Structural Biology. Sep. 2018 203(3):236-241.
Gowanlock D, et al. A designer AAV variant permits efficient retrograde access to projection neurons. Neuron. Oct. 19, 2016;92(2):372-382.
Methods in Molecular Biology, ed. Richard, Humana Press, NJ (1995).

Bosma B, et al. Optimization of viral protein ratios for production of rAAV serotype 5 in the baculovirus system. Gene Ther. Aug. 1, 2018 Epub ahead of print.
Crosson SM, et al. Helper-free Production of Laboratory Grade AAV and Purification by Iodixanol Density Gradient Centrifugation. Mol Ther Methods Clin Dev. May 8, 2018;10:1-7.
Savy A, et al. Genetics instability of wtAAV2 genome and AAV promoter activities in the baculovirus/Sf9 cells system.
Kothari P, et al. Radioiodinated Capsids Facilitate In Vivo Non-Invasive Tracking of Adeno-Associated Gene Transfer Vectors. Sci Rep. Jan. 6, 2017;7:39594.
Paulk NK, et al. Bioengineered AAV Capsids with Combined High Human Liver Transduction In Vivo and Unique Humoral Seroreactivity. Mol Ther. Jan. 3, 2018;26(1):289-303.
Ojala DS, et al. In Vivo Selection of a Computationally Designed SCHEMA AAV Library Yields a Novel Variant for Infection of Adult Neural Stem Cells in the SVZ. Mol Ther. Jan. 3, 2018;26(1):304-319.
Büning and Srivastava. Capsid Modifications for Targeting and Improving the Efficacy of AAV Vectors. vol. 12, p. 248-265, Mar. 15, 2019.
Pillay S, et al. AAV serotypes have distinctive interactions with domains of the cellular receptor AAVR. J Virol. Jul. 5, 2017. Epub ahead of print.
Bennett A, et al. Thermal Stability as a Determinant of AAV Serotype Identity. Mol Ther Methods Clin Dev. Jul. 24, 2017;6:171-182. doi: 10.1016/j.omtm.2017.07.003.
Bennett A, et al. Understanding capsid assembly and genome packaging for adeno-associated viruses. Future Virology Jun. 2017; 12(6): 283-297.
De Silva SR, Charbel Issa P, Singh MS, Lipinski DM, Barnea-Cramer AO, Walker NJ, Barnard AR, Hankins MW, MacLaren RE. Single residue AAV capsid mutation improves transduction of photoreceptors in the Abca4$^{-/-}$ mouse and bipolar cells in the rd1 mouse and human retina ex vivo. Gene Ther. Nov. 2016;23(11):767-774. doi: 10.1038/gt.2016.54. Epub Jul. 14, 2016.
Jin X, et al. Direct LC/MS Analysis for Complete Characterization of Recombinant Adeno-Associated Virus Capsid Proteins. Hum Gene Ther Methods. Jun. 18, 2017. Epub ahead of print.
Galli A, et al. Strategies to optimize capsid protein expression and single stranded DNA formation of Adeno-associated virus in *Saccharomyces cerevisiae*. J Appl Microbiol. Jun. 13, 2017. Epub ahead of print.
Chandran JS, et al. Site Specific Modification of Adeno-Associated Virus Enables Both Fluorescent Imaging of Viral Particles and Characterization of the Capsid Interactome. Sci Rep. Nov. 7, 2017;7(1):14766.
Hickey DG, et al. Tropism of engineered and evolved recombinant AAV serotypes in the rd1 mouse and ex vivo primate retina. Gene Ther. Sep. 5, 2017 Epub ahead of print.
Kanaan NM, et al. Rationally Engineered AAV Capsids Improve Transduction and Volumetric Spread in the CNS. Molecular Therapy-Nucleic Acids 8: 184-197 Sep. 15, 2017.
Chan KY, et al. Engineered AAVs for efficient noninvasive gene delivery to the central and peripheral nervous systems. Nat Neurosci. Jun. 26, 2017 Epub ahead of print.
Smith JK and Agbandje-McKenna M. Creating an arsenal of Adeno-associated virus (AAV) gene delivery stealth vehicles. PLOS Pathogens. May 3;14(5);e1006929.
Chandran JS, et al. Gene therapy in the nervous system: failures and successes. Adv Exp Med Biol. 2017;1007:241-257.
Challis RC, et al. Systemic AAV vectors for widespread and targeted gene delivery in rodents. Nat Protoc. Jan. 9, 2019 [Epub ahead of print].
Fakhiri J et al., Novel chimeric gene therapy vectors based on Adeno-associated virus (AAV) and four different mammalian bocaviruses (BoV).Molecular Therapy Methods & Clinical Development, vol. 12, Mar. 2019, pp. 202-222.
Wang D, et al. Adeno-associated virus vector as a platform for gene therapy delivery. Nat Rev Drug Discov. Feb. 1, 2019. doi: 10.1038/s41573-019-0012-9. [Epub ahead of print] Review.
Chen YH etl a., Viral Vectors for Gene Transfer. Curr Protoc Mouse Biol. Dec. 2018;8(4):e58.

(56) References Cited

OTHER PUBLICATIONS

Hudry E, Vandenberghe LH. Therapeutic AAV Gene Transfer to the Nervous System: A Clinical Reality. Neuron. Mar. 6, 2019;101(5):839-862.
Büning H, Srivastava A. Capsid Modifications for Targeting and Improving the Efficacy of AAV Vectors. Mol Ther Methods Clin Dev. Jan. 26, 2019;12:248-265.
Flotte TR et al., Severe Toxicity in Nonhuman Primates and Piglets with Systemic High-Dose Administration of Adeno-Associated Virus Serotype 9-Like Vectors: Putting Patients First. Hum Gene Ther. Mar. 2018;29(3):283-284.
Challis et al., Systemic AAV vectors for widespread and targeted gene delivery in rodents. Nat Protoc. Feb. 2019;14(2):379-414.
Tomono et al., Infectivity assessment of recombinant adeno-associated virus (rAAV) and wild-type AAV (wtAAV) exposed to various diluents and environmental conditions. Hum Gene Ther Methods. Jul. 18, 2019.
Zhang et al., Capsid engineering overcomes barriers toward Adeno-associated viral (AAV) vector-mediated transduction of endothelial cells. Hum Gene Ther. Aug. 13, 2019. [Epub ahead of print].
Choi et al., AAV Hybrid Serotypes: Improved Vectors for Gene Delivery; Curr Gene Ther. Jun. 2005; 5(3): 299-310.

\* cited by examiner

FIG. 4

CHIMERIC CAPSIDS

CROSS REFERENCE TO RELATED APPLICATIONS

This application is a 35 U.S.C. § 371 U.S. National Stage Entry of International Application No. PCT/US2015/034799 filed Jun. 9, 2015, which claims priority to U.S. Provisional Patent Application No. 62/009,430, filed Jun. 9, 2014 entitled CHIMERIC CAPSIDS and U.S. Provisional Patent Application No. 62/009,435 filed Jun. 9, 2014 entitled COMPOSITIONS AND METHODS FOR VIRAL VECTOR PRODUCTION, the contents of each of which are incorporated herein by reference in their entirety.

REFERENCE TO SEQUENCE LISTING

The present application is being filed along with a Sequence Listing in electronic format. The Sequence Listing is provided as a file entitled 20571008US371_SL.txt, created on Sep. 18, 2018 which is 1,808,612 bytes in size.

FIELD OF THE INVENTION

The present invention relates to compositions and methods for viral vector production and therapeutic uses of these viral vectors.

BACKGROUND OF THE INVENTION

Viruses of the Parvoviridae family are small non-enveloped icosahedral capsid viruses characterized by a single stranded DNA genome. Parvoviridae family viruses consist of two subfamilies: Parvovirinae, which infect vertebrates, and Densovirinae, which infect invertebrates.

Viruses of the Parvoviridae family are used as biological tools due to a relatively simple structure that may be easily manipulated with standard molecular biology techniques. The genome of the virus may be modified to contain a minimum of components for the assembly of a functional recombinant virus, or viral vector, which is loaded with or engineered to express or deliver a desired nucleic acid construct, e.g., a transgene, polypeptide-encoding polynucleotide or modulatory nucleic acid, which may be delivered to a target cell, tissue or organism.

Parvoviridae viral vectors are adaptable to the delivery of a wide range of nucleic acid constructs and are therefore often produced in the laboratory in small volumes with a variable concentration of viral particles. It is well understood, however, that viral vector production for larger scale clinical trials and commercialization using current cell production systems can be cost and time prohibitive. According to U.S. Pat. No. 6,723,551, a typical clinical study may require the production of more than $10^{15}$ viral vector particles. At a production rate of 10,000 viral vector particles per cell, transfection and culture of approximately $10^{11}$ cells would require the equivalent of 5,000 175-cm² flasks of cells without taking into account loss of yield during the purification process. In addition, producing viral vectors for clinical use requires purification strategies to eliminate contaminants that may be present in a viral replication cell.

In view of these and other issues there remains a need for alternative and improved methods for efficiently, safely, and economically producing a large amount of viral vectors. The present invention provides compositions and methods for the improved production of viral vectors, e.g., parvoviral vectors, and consequently more efficacious therapeutic modalities.

SUMMARY OF THE INVENTION

The present invention provides compositions and methods for viral vector production and for improved compositions for capsid design and production. Also provided are engineered constructs useful for viral production methods and as therapeutic modalities which employ viral delivery methods.

The present invention provides methods of producing viral vectors which comprise one or more chimeric polynucleotides or polypeptides, e.g., chimeric capsid proteins, and/or chimeric genomes and/or chimeric ITRs and/or chimeric regulatory proteins and/or chimeric payloads or any combination thereof.

BRIEF DESCRIPTION OF THE FIGURES

The foregoing and other objects, features and advantages will be apparent from the following description of particular embodiments of the invention, as illustrated in the accompanying drawings. The drawings are not necessarily to scale, emphasis instead being placed upon illustrating the principles of various embodiments of the invention.

FIG. 4 is a protein alignment of representative AAV capsid VP3 sequences including a consensus (SEQ ID NO: 429) and AAV2 (SEQ ID NO: 430), AAV1 (SEQ ID NO: 431), AAV5 (SEQ ID NO: 432), AAV8 (SEQ ID NO: 433) and AAV9 (SEQ ID NO: 434), showing structural variable regions (VR) designated VRI-VRIX and HI Loop. In FIG. 4, the amino acids in the variable regions VRI to VRIX and the HI Loop are denoted by the boxes and corresponding text. For example, VRI for the VP3 sequence of AAV2 is amino acid 57 to 67 of AAV2 VP3 sequence. FIG. 4 discloses VRI sequences (SEQ ID NOs: 451-456), VRII sequences (SEQ ID NOs: 457-461), VRIII sequences (SEQ ID NOs: 462-464), VRIV sequences (SEQ ID NOs: 465-470), VRV sequences (SEQ ID NOs: 471-476), VRVI sequences (SEQ ID NOs: 477-482), VRVII sequences (SEQ ID NOs: 483-488), VRVIII sequences (SEQ ID NOs: 489-494), HI loop sequences (SEQ ID NOs: 495-500), and VRIX sequences (SEQ ID NOs: 501-506), respectively, in order of appearance.

In FIG. 6, the amino acids in the variable regions VRI-CNS to VRXII-CNS are denoted by the boxes and corresponding text. For example, VRI-CNS for the VP1 sequence of AAV2 is amino acid 13 to 42. FIG. 6 discloses VRI-CNS sequences (SEQ ID NOs: 507-511), VRII-CNS sequences (SEQ ID NOs: 512-516), VRIII-CNS sequences (SEQ ID NOs: 517-523) VRIV-CNS sequences (SEQ ID NOs: 524-529), VRV-CNS sequences (SEQ ID NOs: 530-534); VRVI-CNS sequences (SEQ ID NOs: 535-539), VRVII-CNS sequences (SEQ ID NOs: 540-546); VRVIII-CNS sequences (SEQ ID NOs: 547-553), VRIX-CNS sequences (SEQ ID NOs: 554-559); VRX-CNS (SEQ ID NOs: 560-567), VRXI-CNS (SEQ ID NOs: 568-574), HI loop sequences (SEQ ID NOs: 575-580), and VRXII-CNS sequences (SEQ ID NOs: 581-586), respectively, in order of appearance.

FIG. 9 discloses SEQ ID NOs. 443-445, respectively, in order of appearance.

FIG. 10 discloses SEQ ID NOs. 446-450, respectively, in order of appearance.

DETAILED DESCRIPTION

Figure 1:
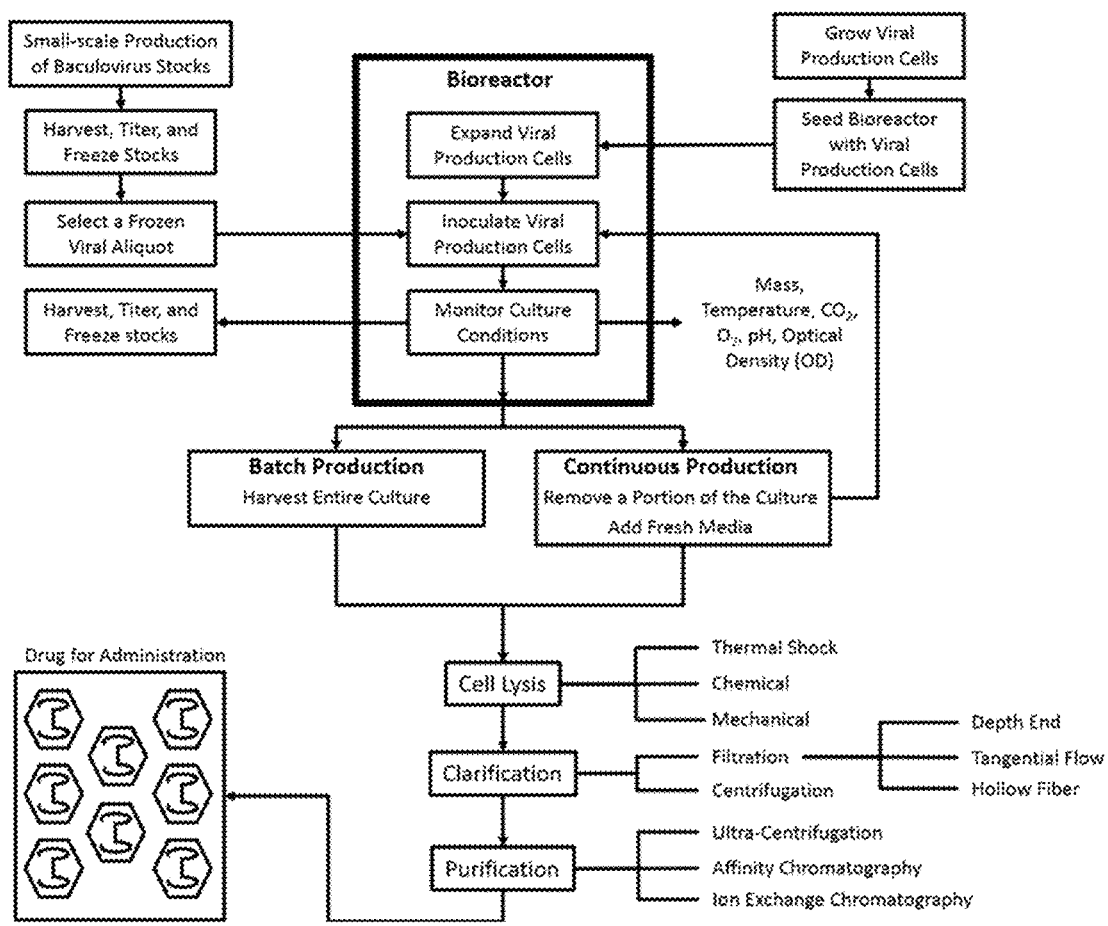
FIG. 1 is a flowchart diagram depicting the steps involved in one method of large scale viral vector production using a baculoviral system.

Parvoviridae family viruses consist of two subfamilies: Parvovirinae, which infect vertebrates, and Densovirinae, which infect invertebrates. The parvoviruses and other members of the Parvoviridae family are generally described in Kenneth I. Berns, "Parvoviridae: The Viruses and Their Replication," Chapter 69 in FIELDS VIROLOGY (3d Ed. 1996), the contents of which is incorporated by reference in its entirety.

Dependoviruses include the viral family of the adeno-associated viruses (AAV) which are capable of replication in vertebrate hosts including, but not limited to, human, primate, bovine, canine, equine, and ovine species.

AAVs have emerged as one of the most widely studied and utilized viral vectors for gene transfer to mammalian cells. See, e.g., Tratschin et al., *Mol. Cell Biol.,* 5(11):3251-3260 (1985) and Grimm et al., Hum. Gene Ther., 10(15): 2445-2450 (1999), the contents of which are herein incorporated by reference in its entirety.

According to the present invention, viral vectors for use in therapeutics and/or diagnostics comprise a virus that has been distilled or reduced to the minimum components necessary for transduction of a nucleic acid payload or cargo of interest.

In this manner, viral vectors are engineered as vehicles for specific delivery while lacking the deleterious replication and/or integration features found in a wild-type virus.

As used herein, a "vector" is any molecule or moiety which transports, transduces or otherwise acts as a carrier of a heterologous molecule. A "viral vector" is a vector which comprises one or more polynucleotide regions encoding or comprising payload molecule of interest, e.g., a transgene, a polynucleotide encoding a polypeptide or multi-polypeptide or a modulatory nucleic acid. Viral vectors of the present invention may be produced recombinantly and may be based on adeno-associated virus (AAV) parent or reference sequence. Such parent or reference AAV sequences may serve as an original, second, third or subsequent sequence for engineering viral vectors. These AAV sequences may serve as either the "donor" sequence of one or more codons (at the nucleic acid level) or amino acids (at the polypeptide level) or "acceptor" sequence of one or more codons (at the nucleic acid level) or amino acids (at the polypeptide level).

As used herein, a "donor" sequence is any polynucleotide or protein from which the codon or amino acid is selected, respectively.

In one embodiment, the donor sequence may be derived from any AAV serotype. In one embodiment, the donor sequence may be derived from AAV2. In another embodiment, the donor sequence may be derived from AAV5. In another embodiment, the donor sequence may be derived from AAV7. In another embodiment, the donor sequence may be derived from AAV8. In yet another embodiment, the donor sequence may be derived from AAVrh8. In yet another embodiment, the donor sequence may be derived from AAV9. In another embodiment, the donor sequence may be derived from AAVrh39. In another embodiment, the donor sequence may be derived from AAVrh43. In yet another embodiment, the donor sequence may be derived from AAV10.

As used herein, an "acceptor" sequence is any polynucleotide or protein into which the codon or amino acid is placed, respectively.

In one embodiment, the acceptor sequence may be any AAV serotype. In one embodiment, the acceptor sequence may be AAV2. In another embodiment, the acceptor sequence may be AAV5. In another embodiment, the acceptor sequence may be AAV7. In another embodiment, the acceptor sequence may be AAV8. In yet another embodiment, the acceptor sequence may be AAVrh8. In yet another embodiment, the acceptor sequence may be AAV9. In another embodiment, the acceptor sequence may be AAVrh39. In another embodiment, the acceptor sequence may be AAVrh43. In yet another embodiment, the acceptor sequence may be AAV10.

Viral vectors of the invention may be packaged in a capsid structure or may be capsid free. Non-limiting examples of capsid free viral vector donor and/or acceptor sequences such as AAV0 are described in, for example, US Publication No. 20140107186, the contents of which are incorporated herein by reference in their entirety.

In one embodiment, the adeno-associated viral (AAV) polynucleotides encoding a chimeric capsid protein described herein may have enhanced transduction, reduced immunogenicity, enhanced crossing the blood-brain barrier, improved expression, and/or increased expression in a baculovirus system as compared to adeno-associated viral (AAV) polynucleotides encoding a non-chimeric capsid protein.

I. Adeno-Associated Viruses (Aavs)

Genome

The AAV genome is a linear, single-stranded DNA (ssDNA) molecule approximately 5,000 nucleotides (nt) in length. Inverted terminal repeats (ITRs) flank the coding nucleotide sequences for the non-structural proteins (encoded by Rep genes) and the structural proteins (encoded by capsid genes or Cap genes). The AAV genome comprises a characteristic T-shaped hairpin structure defined by the self-complementary terminal 145 nt of the 5' and 3' ends of the ssDNA which form an energetically stable double stranded region. The double stranded hairpin structures comprise multiple functions including, but not limited to, acting as an origin for DNA replication by functioning as primers for the endogenous DNA polymerase complex of the host viral replication cell.

The Rep genes encode the non-structural proteins that regulate functions comprising the replication of the AAV genome. Rep78 and Rep68 are transcribed from the p5 promoter, and Rep52 and Rep40 are transcribed from the p19 promoter. The cap gene encodes the structural proteins, VP1, VP2 and/or VP3 that assemble to form the capsid. The Cap genes are transcribed from the p40 promoter.

Viral vectors produced by the method of the invention may comprise the genome, in part or entirety, of any naturally occurring and/or recombinant AAV nucleotide sequence or variant. AAV variants may have genomic sequences of significant homology at the nucleic acid and amino acid levels, produce viral vector which are generally physical and functional equivalents, replicate by similar mechanisms, and assemble by similar mechanisms. Chiorini et al., J. Vir. 71: 6823-33 (1997); Srivastava et al., J. Vir. 45:555-64 (1983); Chiorini et al., J. Vir. 73:1309-1319 (1999); Rutledge et al., J. Vir. 72:309-319 (1998); and Wu et al., J. Vir. 74: 8635-47 (2000), the contents of each of which are herein incorporated by reference in its entirety.

Variant AAV sequences can be used to produce rAAV vectors in insect cells. For example, or more sequences having at least about 70%, at least about 75%, at least about 80%, at least about 85%, at least about 90%, at least about 95%, at least about 99%, or more nucleotide and/or amino acid sequence identity (e.g., a sequence having about 75-99% nucleotide sequence identity) to an AAV1, AAV2, AAV3, and/or AAV4 ITR, Rep, or VP can be used in place of wild-type AAV ITR, Rep, or VP sequences.

Although similar to other AAV serotypes in many respects, AAV5 differs from other human and simian AAV serotypes more than other known human and simian serotypes. For example, AAV5 Rep and ITR sequences are unable to efficiently cross-complement corresponding Rep and ITR sequences from AAV2 in mammalian cells. See, e.g., Chiorini et al., J. Virol., 73(5):4293-4298 (1999) and Chiorini et al., J. Virol., 73(2):1309-1319 (1999), the contents of each of which are herein incorporated by reference in its entirety. This lack of functional homology in AAV5 Rep and ITR sequences may be due to the relatively significant differences in the nucleotide and amino acid sequences of AAV5 from the corresponding sequences of other AAV serotypes. See, e.g., Bantel-Schaal et al., J. Virol., 73(2):939-947 (1999), the contents of which is herein incorporated by reference in its entirety.

In view of these differences, the production of AAV5 can differ from production of other serotypes. For example, the use of AAV5 Rep and ITR sequences can be less suitable than sequences from serotypes 1, 2, 3, and 4 in the context of producing pseudotyped AAV vectors. Despite these and other differences between AAV5 and other human and simian serotypes, the inventors have discovered that rAAV5 and rAAV vectors comprising AAV5 capsid proteins can be produced in insect cells in accordance with the present invention. Where methods of the invention are employed to produce rAAV5, it is preferred that one or more vectors comprising, collectively in the case of more than one vector, a nucleotide sequence comprising an AAV5 ITR, a nucleotide sequence comprises an AAV5 Rep52 and/or Rep40 coding sequence, and a nucleotide sequence comprises an AAV5 Rep78 and/or Rep68 coding sequence. Such ITR and Rep sequences can be modified as desired to obtain efficient production of rAAV5 or pseudotyped rAAV5 vectors in insect cells (e.g., the start codon of the Rep sequences can be modified, VP splice sites can be modified or eliminated, and/or the VP1 start codon and nearby nucleotides can be modified to improve the production of rAAV5 in the insect cell).

In one embodiment, any of the AAV vectors described herein may be produced using a baculovirus production system. As a non-limiting example, the AAV vector may be a chimeric rAAV.

Modifying AAV Rep and/or VP sequences, whether in AAV5 and other AAV serotypes, to produce modified Rep and/or VP sequences to facilitate AAV and AAV genome production in insect cells (e.g., the production of at least about 1 AAV vector genome/cell) is another important feature of the invention. As a non-limiting example, the sequences can be modified through start codon substitutions, codon context modifications, modifying the nucleotide sequences near the VP1 start codon, and other nucleotide sequence modifications described herein (e.g., the elimination of VP sequence splice sites, false codons, and selection of appropriate promoters).

In addition to single stranded DNA viral vectors, the present invention also provides for the production of self-complementary AAV vectors (scAAVs). scAAV vectors contain DNA strands which anneal together to form double stranded DNA. By skipping second strand synthesis, scAAVs allow for rapid expression in the cell.

According to the present invention, any of the AAV sequences listed in Tables 1-6 in whole or in part may serve as a donor or acceptor sequence or as a component of a chimeric viral vector as described herein.

TABLE 1

Adeno-Associated Virus Nucleic Acid Sequences

| SEQ ID NO | Description; Accession Number/GI Number | Region encoding the non-structural/rep protein (Accession Number/GI Number of protein) | Region encoding the capsid protein (Accession Number/GI Number of protein) |
|---|---|---|---|
| 1 | Adeno-associated virus - 1; NC_002077.1/GI: 9632547 | 335-2206 (NP_049541.1/GI: 9632549) | 2223-4443 (NP_049542.1/GI: 9632548) |
| 1 | Adeno-associated virus - 1; AF063497.1/GI: 4689096 | 335-2206 (AAD27758.1/GI: 4689098) | 2223-4433 (AAD27757.1/GI: 4689097) |
| 2 | Adeno-associated virus - 3; NC_001729.1/GI: 9628918 U48704.1/GI: 1408467 | 318-2192 (NP_043940.1/GI: 9628919 AAC55048.1 and GI: 1408468) | 2209-4419 (NP_043941.1; GI: 9628920 and AAC55049.1/GI: 1408469) |
| 3 | Adeno-associated virus 3B; AF028705.1/GI: 2766608 NC_001863.1/GI: 9629897 | 317-2191 (AAB95451.1/GI: 2766609 and AAB95451.1/GI: 2766609) | 2208-4418 (AAB95452.1/GI: 2766610 and AAB95452.1/GI: 2766610) |
| 4 | Adeno-associated virus 4; NC_001829.1/GI: 9629641 U89790.1/GI: 2337938 | 372-2243 (NP_044926.1/GI: 9629642 and AAC58044.1/GI: 2337939) | 2260-4464 (NP_044927.1/GI: 9629643 and AAC58045.1/GI: 2337940) |
| 5 | Adeno-associated virus 5; NC_006152.1/GI: 51593836 AF085716.1/GI: 4249656 | 359-2191 (YP_068408.1/GI: 51593837 and AAD13755.1/GI: 4249657) | 2207-4381 (YP_068409.1/GI: 51593838 and AAD13756.1/GI: 4249658) |
| 6 | Adeno-associated virus 5; Y18065.1/GI: 4160146 | 239-2071 (CAA77023.1/GI: 4160147) | 2087-4261 (CAA77024.1/GI: 4160148) |
| 7 | Adeno-associated virus - Go.1; DQ335246.2/GI: 108756766 | 347-2179 (ABC69725.1/GI: 85070097) | 2195-4375 (ABC69726.1/GI: 85070098) |
| 8 | Adeno-associated virus 6; AF028704.1/GI: 2766605 NC_001862.1/GI: 9629894 | 320-2191 (AAB95449.1/GI: 2766606 and NP_045757.1/GI: 9629895) | 2208-4418 (AAB95450.1/GI: 2766607 and NP_045758.1/GI: 9629896) |
| 9 | Adeno-associated virus - 7; NC_006260.1/GI: 51949960 AF513851.1/GI: 22652859 | 334-2205 (YP_077177.1/GI: 51949961 and AAN03854.1/GI: 22652860) | 2222-4435 (YP_077178.1/GI: 51949962 and AAN03855.1/GI: 22652861) |
| 10 | Adeno-associated virus - 8; NC_006261.1/GI: 51949963 AF513852.1/GI: 22652862 | 227-2104 (YP_077179.1/GI: 51949964 and AAN03856.1/GI: 22652863) | 2121-4337 (YP_077180.1/GI: 51949965 and AAN03857.1/GI: 22652864) |
| 11 | Adeno-associated virus 9; AX753250.1/GI: 32166107 | | |
| 12 | Adeno-associated virus 10; AY631965.1/GI: 48728341 | 1-1869 (AY631965.1/GI: 48728341) | 1886-4102 (AAT46337.1/GI: 48728343) |
| 13 | Adeno-associated virus 11; AY631966.1/GI: 48728344 | 1-1869 (AAT46338.1/GI: 48728345) | 1886-4087 (AAT46339.1/GI: 48728346) |
| 14 | Adeno-associated virus 12; DQ813647.1/GI: 112379654 | 103-1968 (ABI16638.1/GI: 112379655) | 1985-4213 (ABI16639.1; GI: 112379656) |
| 15 | Adeno-associated virus 13; EU285562.1/GI: 167047085 | 60-1931 (ABZ10811.1/GI: 167047086) | 1948-4149 (ABZ10812.1/GI: 167047087) |

TABLE 2

Adeno-Associated Virus - 2 Nucleic Acid Sequence

| SEQ ID NO | Description; Accession Number/GI Number |
|---|---|
| 16 | Adeno-associated virus-2; NC_001401.2/GI: 110645916 |

TABLE 3

Adeno-Associated Virus - 2 Sequence Regions

| Description | Accession Number/ GI Number | SEQ ID NO | Corresponding Nucleotide Region from Table 2 |
|---|---|---|---|
| Adeno-associated virus - 2 ITR | K01624.1/GI: 209623 | 17 | 1-145 |
| Adeno-associated virus - 2 Rep 68 | YP_680422.1/GI: 110645917 AAC03774.1/GI: 2906017 | 18 | 321-1906 joined with 228-2252 |
| Adeno-associated virus - 2 Rep 78 | YP_680423.1/GI: 110645918 AAC03775.1/GI: 2906018 | 19 | 321-2186 |
| Adeno-associated virus - 2 Rep 40 | YP_680424.1; GI: 110645919 AAC03776.1/GI: 2906019 | 20 | 993-1906 joined with 2228-2252 |
| Adeno-associated virus - 2 Rep 52 | YP_680425.1/GI: 110645920 AAC03777.1/GI: 2906020 | 21 | 993-2186 |
| Adeno-associated virus - 2 Capsid (VP1) | YP_680426.1/GI: 110645923 AAC03780.1/GI: 2906023 | 22 | 2203-4410 |
| Adeno-associated virus - 2 Capsid (VP2) | YP_680427.1/GI: 110645921 AAC03778.1/GI: 2906021 | 23 | 2614-4410 |
| Adeno-associated virus - 2 Capsid (VP3) | YP_680428.1/GI: 110645922 AAC03779.1/GI: 2906022 | 24 | 2809-4410 |
| Adeno-associated virus - 2 Assembly Activating Protein (AAP) | YP_004030758.1/GI: 312281378 ADH10168.1/GI: 296327241 | 25 | 2729-3343 |
| Adeno-associated virus - 2 ITR | K01625.1/209624 | 26 | 4535-4679 |

TABLE 4

Adeno-Associated Virus - 2 Nucleic Acid Sequence

| SEQ ID NO | Description | Accession Number/ GI Number |
|---|---|---|
| 27 | Adeno-associated virus - 2 | J01901.1/GI: 209616 |

TABLE 5

Adeno-Associated Virus - 2 Sequence Regions

| Description | Accession Number/ GI Number | SEQ ID NO | Corresponding Nucleotide Region from Table 4 |
|---|---|---|---|
| Adeno-associated virus - 2 ITR | — | — | 1-145 |
| Adeno-associated virus - 2 Rep 68 | AAA42372.1/ GI: 209617 | 28 | 321-1906 joined with 228-2252 |
| Adeno-associated virus - 2 Rep 78 | AAA42374.1/ GI: 209619 | 29 | 321-2186 |
| Adeno-associated virus - 2 Rep 40 | AAA42373.1/ GI: 209618 | 20 | 993-1906 joined with 2228-2252 |
| Adeno-associated virus - 2 Rep 52 | AAA42375.1/ GI: 209620 | 21 | 993-2186 |
| Adeno-associated virus - 2 Capsid | AAA42376.1/ GI: 209621 | 30 | 2810-4324 |
| Adeno-associated virus - 2 ITR | — | — | 4535-4679 |

TABLE 6

Adeno-Associated Virus Sequences for Various Species

| Description | Accession Number/ GI Number | SEQ ID NO | ITR | Region encoding the non-structural/rep protein (Accession Number/ GI Number of protein) | Region encoding the capsid protein (Accession Number/ GI Number of protein) |
|---|---|---|---|---|---|
| Adeno-associated virus | | | | | |
| Adeno-associated virus isolate hu.T32 Rep78 protein and capsid protein VP1 (cap) genes, complete cds. | AY695371.1/ GI: 51512232 | 31 | | 196-2061 (AAU05359.1/ GI: 51512233) | 2078-4285 (AAU05360.1/ GI: 51512234) |
| Adeno-associated virus isolate hu.T40 Rep78 protein and capsid protein VP1 (cap) genes, complete cds. | AY695372.1/ GI: 51512235 | 32 | | 196-2061 (AAU05361.1/ GI: 51512236) | 2078-4285 (AAU05362.1/ GI: 51512237) |
| Adeno-associated virus isolate hu.T70 Rep78 protein and capsid protein VP1 (cap) genes, complete cds. | AY695373.1/ GI: 51512238 | 33 | | 196-2061 (AAU05363.1/ GI: 51512239) | 2078-4285 (AAU05364.1/ GI: 51512240) |
| Adeno-associated virus isolate hu.T71 Rep78 protein and capsid protein VP1 (cap) genes, complete cds. | AY695374.1/ GI: 51512241 | 34 | | 196-2061 (AAU05365.1/ GI: 51512242) | 2078-4285 (AAU05366.1/ GI: 51512243) |
| Adeno-associated virus isolate hu.T88 Rep78 protein and capsid protein VP1 (cap) genes, complete cds. | AY695375.1/ GI: 51512244 | 35 | | 196-2061 (AAU05367.1/ GI: 51512245) | 2078-4285 (AAU05368.1/ GI: 51512246) |
| Adeno-associated virus isolate hu.S17 Rep78 protein and capsid protein VP1 (cap) genes, complete cds. | AY695376.1/ GI: 51512247 | 36 | | 196-2061 (AAU05369.1/ GI: 51512248) | 2078-4285 (AAU05370.1/ GI: 51512249) |
| Adeno-associated virus - Po1 | | | | | |
| Adeno-associated virus-Po1 Rep gene, partial cds; and VP1, VP2, and VP3 genes, complete cds. | FJ688147.1/ GI: 224384438 | 37 | | 1-764 (ACN42943.1/ GI: 224384442) | 780-2930 (ACN42940.1/ GI: 224384439) 1188-2930 (ACN42941.1/ GI: 224384440) 1329-2930 (ACN42942.1/ GI: 224384441) |
| Adeno-associated virus VR-195 | | | | | |
| Adeno-associated virus VR-195 Rep78 (rep78) and capsid protein (cap) genes, complete cds. | DQ180604.1/ GI: 77380105 | 38 | | 103-1974 (ABA71698.1/ GI: 77380106) | 1991-4201 (ABA71699.1/ GI: 77380107) |
| Adeno-associated virus VR-355 | | | | | |
| Adeno-associated virus VR-355 Rep78 (rep78) and capsid protein (cap) genes, complete cds. | DQ180605.1/ GI: 77380108 | 39 | | 102-1973 (ABA71700.1/ GI: 77380109) | 1990-4200 (ABA71701.1/ GI: 77380110) |
| Avian adeno-associated virus | | | | | |
| Avian adeno-associated virus isolate YZ-1, complete genome | GQ368252.1/ GI: 255710032 | 40 | | 243-2237 (ACU30841.1/ GI: 255710033) | 2255-4471 (ACU30842.1/ GI: 255710034) |
| Avian adeno-associated virus isolate ZN1, complete genome | KF937794.1/ GI: 588284633 | 41 | 1-142 4540-4682 | 244-2235 (AHK22792.1/ GI: 588284634) | 2253-4469 (AHK22793.1/ GI: 588284635) |
| Avian adeno-associated virus ATCC VR-865 | | | | | |
| Avian adeno-associated virus ATCC VR-865, complete genome | AY186198.1/ GI: 31414777 | 42 | 1-142 4552-4694 | 244-2232 (AAO32086.1/ GI: 31414778) | 2250-4481 (AAO32087.1/ GI: 31414779) |

TABLE 6-continued

Adeno-Associated Virus Sequences for Various Species

| Description | Accession Number/ GI Number | SEQ ID NO | ITR | Region encoding the non-structural/rep protein (Accession Number/ GI Number of protein) | Region encoding the capsid protein (Accession Number/ GI Number of protein) |
|---|---|---|---|---|---|
| Avian adeno-associated virus ATCC VR-865, complete genome | NC_004828.1/ GI: 31543992 | 42 | 1-142 4552-4694 | 244-2232 (NP_852780.1/ GI: 31543993) | 2250-4481 (NP_852781.1/ GI: 31543994) |
| Avian adeno-associated virus ATCC VR-865, complete genome | AY629582.1/ GI: 48996102 | 42 | 1-142 4552-4694 | 244-2232 (AAT48612.1/ GI: 48996103) | 2250-4481 (AAT48613.1/ GI: 48996104) |
| Avian adeno-associated virus strain DA-1 | | | | | |
| Avian adeno-associated virus strain DA-1, complete genome | AY629583.1/ GI: 48996105 | 43 | 1-142 4540-4682 | 244-2235 (AAT48614.1/ GI: 48996106) | 2253-4469 (AAT48615.1/ GI: 48996107) |
| Avian adeno-associated virus strain DA-1, complete genome | NC_006263.1/ GI: 51949968 | 43 | 1-142 4540-4682 | 244-2235 (YP_077182.1/ GI: 51949969) | 2253-4469 (YP_077183.1/ GI: 51949970) |
| Bat adeno-associated virus YNM | | | | | |
| Bat adeno-associated virus YNM, complete sequence | GU226971.1/ GI: 289719008 | 44 | | 200-2041 (ADD17085.1/ GI: 289719009) | 2059-4233 (ADD17086.1/ GI: 289719010) |
| Bat adeno-associated virus YNM, complete genome | NC_014468.1/ GI: 304422916 | 44 | | 200-2041 (YP_003858571.1/ GI: 304422917) | 2059-4233 (YP_003858572.1/ GI: 304422918) |
| Bovine adeno-associated virus | | | | | |
| Bovine adeno-associated virus, complete genome | AY388617.1/ GI: 38679253 | 45 | | 368-2200 (AAR26464.1/ GI: 38679254) | 2216-4426 (AAR26465.1/ GI: 38679255) |
| Bovine adeno-associated virus, complete genome | NC_005889.1/ GI: 48696557 | 45 | | 368-2200 (YP_024970.1/ GI: 48696558) | 2216-4426 (YP_024971.1/ GI: 48696559) |
| Bovine parvovirus - 2 | | | | | |
| Bovine parvovirus 2 putative non-structural protein and putative capsid protein genes, complete cds. | AF406966.1/ GI: 15825370 | 46 | | 306-1919 (AAL09671.1/ GI: 15825371) | 2268-5384 (AAL09672.1/ GI: 15825372) |
| Bovine parvovirus 2, complete genome | NC_006259.1/ GI: 51949957 | 46 | | 306-1919 (YP_077175.1/ GI: 51949958) | 2268-5384 (YP_077176.1/ GI: 51949959) |
| California sea lion adeno-associated virus 1 | | | | | |
| California sea lion adeno-associated virus 1 isolate 1136 Rep78 and VP1 genes, complete cds. | JN420371.1/ GI: 34345896 | 47 | | 284-2086 (AEM37641.1/ GI: 343458967) | 2117-4273 (AEM37642.1/ GI: 343458968) |
| California sea lion adeno-associated virus 1 isolate 1187 Rep78 and VP1 genes, complete cds. | JN420372.1/ GI: 343458969 | 48 | | 291-2093 (AEM37643.1/ GI: 343458970) | 2124-4280 (AEM37644.1/ GI: 343458971) |
| Goose parvovirus | | | | | |
| Goose parvovirus virulent B strain, complete genome | (U25749.1/GI: 1113795) | 49 | 1-444 4663-5106 | 537-2420 (AAA83229.1/ GI: 1113796) | 2439-4637 (AAA83230.1/ GI: 1113797) 2874-4637 (AAA83231.1/ GI: 1113798) 3033-4637 (AAA83232.1/ GI: 1113799) |
| Goose parvovirus, complete genome | (NC_001701.1/ GI: 9628649) | 49 | 1-444 4663-5106 | 537-2420 (NP_043514.1/ GI: 9628650) | 2439-4637 (NP_043515.1/ GI: 9628651) 2874-4637 |

TABLE 6-continued

Adeno-Associated Virus Sequences for Various Species

| Description | Accession Number/ GI Number | SEQ ID NO | ITR | Region encoding the non-structural/rep protein (Accession Number/ GI Number of protein) | Region encoding the capsid protein (Accession Number/ GI Number of protein) |
|---|---|---|---|---|---|
| | | | | | (NP_043516.1/ GI: 9628652) 3033-4637 (NP_043517.1/ GI: 9628653) |
| Goose parvovirus strain 82-0321V, complete genome | (EU583389.1/ GI: 190888188) | 50 | 1-381 4600-4980 | 474-2357 (ACE95848.1/ GI: 190888189) | 2376-4574 (ACE95849.1/ GI: 190888190) |
| Goose parvovirus strain 82-0321, complete genome | (EU583390.1/ GI: 190888191) | 51 | 1-416 4635-5050 | 509-2392 (ACE95850.1/ GI: 190888192) | 2411-4609 (ACE95851.1/ GI: 190888193) |
| Goose parvovirus strain 06-0329, complete genome | (EU583391.1/ GI: 190888194) | 52 | 1-418 4637-5054 | 511-2394 (ACE95852.1/ GI: 190888195) | 2413-4611 ACE95853.1/ GI: 190888196) |
| Goose parvovirus strain VG32/1, complete genome | (EU583392.1/ GI: 190888197) | 53 | 1-443 4662-5104 | 536-2419 (ACE95854.1/ GI: 190888198) | 2438-4636 (ACE95855.1/ GI: 190888199) |
| Goose parvovirus strain SH, complete genome | (JF333590.1/ GI: 343113618) | 54 | 1-444 4663-5106 | 537-2420 (AEL87777.1/ GI: 343113619) | 2439-4637 (AEL87778.1/ GI: 343113620) 2874-4637 (AEL87779.1/ GI: 343113621) 3033-4637 (AEL87780.1/ GI: 343113622) |
| Goose parvovirus strain GDaGPV, complete genome | (HQ891825.1/ GI: 359843307) | 55 | 1-444 4663-5106 | 537-2420 (AEV89789.1/ GI: 359843308) | 2439-4637 (AEV89790.1/ GI: 359843309) 2874-4637 (AEV89791.1/ GI: 359843310) 3033-4637 (AEV89792.1/ GI: 359843311) |
| Goose parvovirus strain SHFX1201, complete genome | (KC478066.1/ GI: 459360514) | 56 | 1-416 | 509-2392 (AGG56527.1/ GI: 459360515) | 2411-4609 (AGG56528.1/ GI: 459360516) |
| Goose parvovirus strain Y, complete genome | (KC178571.1/ GI: 513129761) | 57 | 1-444 | 537-2420 (AGO17637.1/ GI: 513129762) | 2439-4637 (AGO17638.1/ GI: 513129763) |
| Goose parvovirus strain E, complete genome | (KC184133.1/ GI: 513129764) | 58 | 1-443 | 536-2419 (AGO17639.1/ GI: 513129765) | 2438-4636 (AGO17640.1/ GI: 513129766) |
| Goose parvovirus strain SYG61v, complete genome | (KC996729.1/ GI: 531997217) | 59 | 1-442 | 535-2418 (AGT62580.1/ GI: 531997218) | 2437-4635 (AGT62581.1/ GI: 531997219) |
| Goose parvovirus strain YZ99-6, complete genome | (KC996730.1/ GI: 531997220) | 60 | 1-414 | 507-2390 (AGT62582.1/ GI: 531997221) | 2409-4607 (AGT62583.1/ GI: 531997222) |
| Goose parvovirus nonstructural protein NS (ns) and capsid protein VP (vp) genes, complete cds. | (AF416726.1/ GI: 17226299) | 61 | | 1-1884 (AAL37721.1/ GI: 17226300) 529-1884 (ABP93843.1/ GI: 145694447) | 1903-4101 (AAL37722.1/ GI: 17226301) |
| Goose parvovirus strain DY NS1 (NS1), NS2 (NS2), VP1 (VP1), VP2 (VP2), and VP3 (VP3) genes, complete cds. | (EF515837.1/ GI: 145694445) | 62 | | 1-1884 (ABP93842.1/ GI: 145694446) | 1903-4101 (ABP82770.1/ GI: 145573169) 2338-4101 (ABP93844.1/GI: 145694448) 2497-4101 (ABP93845.1/ GI: 145694449) |

TABLE 6-continued

Adeno-Associated Virus Sequences for Various Species

| Description | Accession Number/ GI Number | SEQ ID NO | ITR | Region encoding the non-structural/rep protein (Accession Number/ GI Number of protein) | Region encoding the capsid protein (Accession Number/ GI Number of protein) |
|---|---|---|---|---|---|
| Goose parvovirus strain PT NS1 protein and VP1 protein genes, complete cds. | (JF926695.1/ GI: 354463162) | 63 | | 9-1892 (AER25356.1/ GI: 354463163) | 1911-4109 (AER25357.1/ GI: 354463164) |
| Goose parvovirus strain D NS1 protein and VP1 protein genes, complete cds. | (JF926696.1/ GI: 354463165) | 64 | | 6-1889 (AER25358.1/ GI: 354463166) | 1908-4106 (AER25359.1/ GI: 354463167) |
| Mouse adeno-associated virus 1 | | | | | |
| Mouse adeno-associated virus 1 rep gene, partial cds; and VP1 capsid, VP2 capsid, and VP3 capsid genes, complete cds. | DQ100362.1/ GI: 73665994 | 65 | | 1-327 (AAZ79671.1/ GI: 73665995) | 344-2485 (AAZ79672.1/ GI: 73665996) 731-2485 (AAZ79673.1/ GI: 73665997) 911-2485 (AAZ79674.1/ GI: 73665998) |
| Muscovy duck parvovirus | | | | | |
| Barbarie duck parvovirus REP protein (rep) and three capsid protein VP (vp) genes, complete cds | U22967.1/GI: 1113784 | 66 | 1-457 4678-5132 | 548-2431 (AAA83224.1/ GI: 1113785) | 2450-4648 (AAA83225.1/ GI: 1113786) 2885-4648 (AAA83226.1/ GI: 1113787) 3044-4648 (AAA83227.1/ GI: 1113788) |
| Muscovy duck parvovirus, complete genome | NC_006147.2/ GI: 51593841 | 66 | 1-457 4678-5132 | 548-2431 (YP_068410.1/ GI: 51593842) | 2450-4648 (YP_068411.1/ GI: 51593843) 2885-4648 (YP_068412.1; GI: 51593844) 3044-4648 (YP_068413.1/ GI: 51593845) |
| Muscovy duck parvovirus strain P REP protein and VP1 protein genes, complete cds. | JF926697.1/ GI: 354463168 | 67 | | 61-1944 (AER25360.1/ GI: 354463169) | 1963-4161 (AER25361.1/ GI: 354463170) |
| Muscovy duck parvovirus strain P1 REP protein and VP1 protein genes, complete cds. | JF926698.1/ GI: 354463171 | 68 | | 61-1944 (AER25362.1/ GI: 354463172) | 1963-4161 (AER25363.1/ GI: 354463173) |
| Muscovy duck parvovirus isolate SAAS-SHNH, complete genome | KC171936.1/ GI: 459256867 | 69 | 1-381 4681-5061 | 512-2395 (AGG53766.1/ GI: 459256868) | 2414-4612 (AGG53768.1/ GI: 459256870) 2849-4612 (AGG53769.1/ GI: 459256871) 3008-4612 (AGG53767.1/ GI: 459256869) |
| Serpentine adeno-associated virus 2 | | | | | |
| Serpentine adeno-associated virus 2 non-structural protein 1 and capsid protein genes, partial cds | EU872429.1/ GI: 215401981 | 70 | | 1-642 (ACJ66590.1/ GI: 215401982) | 661-1297 (ACJ66591.1/ GI: 215401983) |
| Snake parvovirus 1 | | | | | |
| Snake parvovirus 1 non-structural protein 1 | AY349010.1/ GI: 38017148 | 71 | | 324-2012 (AAR07954.1/ | 2030-4210 (AAR07955.1/ |

TABLE 6-continued

Adeno-Associated Virus Sequences for Various Species

| Description | Accession Number/ GI Number | SEQ ID NO | ITR | Region encoding the non-structural/rep protein (Accession Number/ GI Number of protein) | Region encoding the capsid protein (Accession Number/ GI Number of protein) |
| --- | --- | --- | --- | --- | --- |
| (NS1) and capsid protein (VP1) genes, complete cds | | | | GI: 38017149) | GI: 38017150) |
| Snake parvovirus 1, complete genome | NC_006148.1/ GI: 51555744 | 71 | | 324-2012 (YP_068093.1/ GI: 51555745) | 2030-4210 (YP_068094.1/ GI: 51555746) |

In one embodiment, the adeno-associated virus sequence may be any of the sequences related to AAV2 described in European Patent Application No. EP1164195, the contents of which are herein incorporated by reference in its entirety, such as, but not limited to, SEQ ID NOs: 1-12 of European Patent Application No. EP1164195.

In one embodiment, the adeno-associated virus sequence may be any of the sequences described in European Patent Application No. EP1279740, the contents of which are herein incorporated by reference in its entirety, such as, but not limited to, SEQ ID NOs: 1-5 of European Patent Application No. EP1279740.

In one embodiment, the adeno-associated virus sequence may be isolated or detected by the methods described in European Patent No. EP1310571, the contents of which are herein incorporated by reference in its entirety. As a non-limiting example, the adeno-associated virus sequence may be any of the sequences described in European Patent No. EP1310571 such as, but not limited to, SEQ ID NOs: 1, 4-59 and 115-120.

In one embodiment, the adeno-associated virus sequence may be any of the AAV vector related sequences described in U.S. Pat. No. 7,169,612, the contents of which are herein incorporated by reference in its entirety, such as, but not limited to, SEQ ID NO: 5 of U.S. Pat. No. 7,169,612.

In one embodiment, the adeno-associated virus sequence may be any of the sequences related to AAV1 described in European Patent Application No. EP1845163, the contents of which are herein incorporated by reference in its entirety, such as, but not limited to, SEQ ID NOs: 1, 4, 6, 8, 10, 12, 14, 16, and 18-20 of European Patent Application No. EP1845163.

In one embodiment, the adeno-associated virus sequence may be any of the sequences described in European Patent Application No. EP1847614, the contents of which are herein incorporated by reference in its entirety, such as, but not limited to, SEQ ID NOs: 1-12 of European Patent Application No. EP1847614.

In one embodiment, the adeno-associated virus sequence may be any of the AAV vector related sequences described in European Patent Application No. EP1849872, the contents of which are herein incorporated by reference in its entirety, such as, but not limited to, SEQ ID NOs: 1-4, 6, and 7 of European Patent Application No. EP1849872.

In one embodiment, the adeno-associated virus sequence may be any of the sequences described in European Patent Application No. EP2292779, the contents of which are herein incorporated by reference in its entirety, such as, but not limited to, SEQ ID NOs: 1-82, 165-180, 182 and 199-215 of European Patent Application No. EP2292779.

In one embodiment, the adeno-associated virus sequence may be any of the sequences described in European Patent Application No. EP2292780, the contents of which are herein incorporated by reference in its entirety, such as, but not limited to, SEQ ID NOs: 1-82, 165-180, 182 and 199-215 of European Patent Application No. EP2292780.

In one embodiment, the adeno-associated virus sequence may be any of the sequences described in European Patent Application No. EP2298926, the contents of which are herein incorporated by reference in its entirety, such as, but not limited to, SEQ ID NOs: 1-82, 165-180, 182 and 199-215 of European Patent Application No. EP2298926.

In one embodiment, the adeno-associated virus sequence may be any of the sequences described in European Patent Application No. EP2345731, the contents of which are herein incorporated by reference in its entirety, such as, but not limited to, SEQ ID NOs: 1-82, 165-180, 182 and 199-215 of European Patent Application No. EP2345731.

In one embodiment, the adeno-associated virus sequence may be any of the AAV vector related sequences described in European Patent Application No. EP2311966, the contents of which are herein incorporated by reference in its entirety, such as, but not limited to, SEQ ID NO: 7 of European Patent Application No. EP2311966.

In one embodiment, the adeno-associated virus sequence may be any of the AAV vector related sequences described in European Patent Application No. EP2311967, the contents of which are herein incorporated by reference in its entirety, such as, but not limited to, SEQ ID NO: 7 of European Patent Application No. EP2311967.

In one embodiment, the adeno-associated virus sequence may be any of the AAV vector related sequences described in European Patent Application No. EP2357010, the contents of which are herein incorporated by reference in its entirety, such as, but not limited to, SEQ ID NOs: 7 and 11-19 of European Patent Application No. EP2357010.

In one embodiment, the adeno-associated virus sequence may be any of the AAV vector related sequences described in European Patent Application No. EP2359865, the contents of which are herein incorporated by reference in its entirety, such as, but not limited to, SEQ ID NOs: 7 and 11-19 of European Patent Application No. EP2359865.

In one embodiment, the adeno-associated virus sequence may be any of the AAV vector related sequences described in European Patent Application No. EP2359866, the contents of which are herein incorporated by reference in its entirety, such as, but not limited to, SEQ ID NOs: 7 and 11-19 of European Patent Application No. EP2359866.

In one embodiment, the adeno-associated virus sequence may be any of the AAV vector related sequences described in European Patent Application No. EP2359867, the contents of which are herein incorporated by reference in its entirety, such as, but not limited to, SEQ ID NOs: 7 and 11-19 of European Patent Application No. EP2359867.

In one embodiment, the adeno-associated virus sequence may be any of the AAV vector related sequences described in European Patent Application No. EP2383346, the contents of which are herein incorporated by reference in its entirety, such as, but not limited to, SEQ ID NOs: 7 and 11-19 of European Patent Application No. EP2383346.

In one embodiment, the adeno-associated virus sequence may be any of the sequences related to AAV8 described in European Patent Application No. EP2359869, the contents of which are herein incorporated by reference in its entirety, such as, but not limited to, SEQ ID NO: 8 of European Patent Application No. EP2359869.

In one embodiment, the adeno-associated virus sequence may be any of the sequences related to AAV8 described in U.S. Pat. No. 7,282,199, the contents of which are herein incorporated by reference in its entirety, such as, but not limited to, SEQ ID NO: 1 of U.S. Pat. No. 7,282,199.

In one embodiment, the adeno-associated virus sequence may be any of the sequences related to AAV8 described in U.S. Pat. No. 7,790,449, the contents of which are herein incorporated by reference in its entirety, such as, but not limited to, SEQ ID NO: 1 of U.S. Pat. No. 7,790,449.

In one embodiment, the adeno-associated virus sequence may be any of the sequences related to AAV8 described in U.S. Pat. No. 8,318,480, the contents of which are herein incorporated by reference in its entirety, such as, but not limited to, SEQ ID NO: 1 of U.S. Pat. No. 8,318,480.

In one embodiment, the adeno-associated virus sequence may be any of the AAV vector related sequences or capsid free AAV vectors described in European Patent Application No. EP2500434, the contents of which are herein incorporated by reference in its entirety, such as, but not limited to, SEQ ID NOs: 1-6 of European Patent Application No. EP2500434.

In one embodiment, the adeno-associated virus sequence may be any of the sequences described in European Patent Application No. EP2660325, the contents of which are herein incorporated by reference in its entirety, such as, but not limited to, SEQ ID NOs: 1-158 of European Patent Application No. EP2660325.

In one embodiment, the adeno-associated virus sequence may be any of the AAV vector related sequences described in U.S. Pat. No. 5,474,935, the contents of which are herein incorporated by reference in its entirety, such as, but not limited to, SEQ ID NOs: 1-4 of U.S. Pat. No. 5,474,935.

In one embodiment, the adeno-associated virus sequence may be any of the AAV vector related sequences described in U.S. Pat. No. 5,587,308, the contents of which are herein incorporated by reference in its entirety, such as, but not limited to, SEQ ID NOs: 1-12 of U.S. Pat. No. 5,587,308.

In one embodiment, the adeno-associated virus sequence may be any of the AAV vector related sequences described in U.S. Pat. No. 5,658,785, the contents of which are herein incorporated by reference in its entirety, such as, but not limited to, SEQ ID NOs: 1-3 of U.S. Pat. No. 5,658,785.

In one embodiment, the adeno-associated virus sequence may be any of the AAV vector related sequences described in U.S. Pat. No. 5,693,531, the contents of which are herein incorporated by reference in its entirety, such as, but not limited to, SEQ ID NO: 1 of U.S. Pat. No. 5,693,531.

In one embodiment, the adeno-associated virus sequence may be any of the AAV vector related sequences described in U.S. Pat. No. 5,858,775, the contents of which are herein incorporated by reference in its entirety, such as, but not limited to, SEQ ID NOs: 1-3 of U.S. Pat. No. 5,858,775.

In one embodiment, the adeno-associated virus sequence may be any of the AAV vector related sequences described in U.S. Pat. No. 5,866,696, the contents of which are herein incorporated by reference in its entirety, such as, but not limited to, SEQ ID NOs: 1-13 of U.S. Pat. No. 5,866,696.

In one embodiment, the adeno-associated virus sequence may be any of the AAV vector related sequences described in U.S. Pat. No. 5,952,221, the contents of which are herein incorporated by reference in its entirety, such as, but not limited to, SEQ ID NOs: 1-11 of U.S. Pat. No. 5,952,221.

In one embodiment, the adeno-associated virus sequence may be any of the AAV vector related sequences described in U.S. Pat. No. 5,962,313, the contents of which are herein incorporated by reference in its entirety, such as, but not limited to, SEQ ID NOs: 1-8 of U.S. Pat. No. 5,962,313.

In one embodiment, the adeno-associated virus sequence may be any of the AAV vector related sequences described in U.S. Pat. No. 5,989,540, the contents of which are herein incorporated by reference in its entirety, such as, but not limited to, SEQ ID NOs: 1-13 of U.S. Pat. No. 5,989,540.

In one embodiment, the adeno-associated virus sequence may be any of the AAV vector related sequences described in U.S. Pat. No. 6,200,560, the contents of which are herein incorporated by reference in its entirety, such as, but not limited to, SEQ ID NOs: 1-14 of U.S. Pat. No. 6,200,560.

In one embodiment, the adeno-associated virus sequence may be any of the adenovirus related sequences described in U.S. Pat. No. 6,270,996, the contents of which are herein incorporated by reference in its entirety, such as, but not limited to, SEQ ID NOs: 1 and 3-5 of U.S. Pat. No. 6,270,996.

In one embodiment, the adeno-associated virus sequence may be any of the AAV vector related sequences described in U.S. Pat. No. 6,416,992, the contents of which are herein incorporated by reference in its entirety, such as, but not limited to, SEQ ID NOs: 2-6 of U.S. Pat. No. 6,416,992.

In one embodiment, the adeno-associated virus sequence may be any of the AAV vector related sequences described in U.S. Pat. No. 6,436,392, the contents of which are herein incorporated by reference in its entirety, such as, but not limited to, SEQ ID NOs: 1-13 of U.S. Pat. No. 6,436,392.

In one embodiment, the adeno-associated virus sequence may be any of the AAV vector related sequences or adenovirus chimeric recombinant viruses described in U.S. Pat. No. 6,468,771, the contents of which are herein incorporated by reference in its entirety, such as, but not limited to, SEQ ID NOs: 1-12 of U.S. Pat. No. 6,468,771.

In one embodiment, the adeno-associated virus sequence may be any of the AAV vector related sequences described in U.S. Pat. No. 6,509,150, the contents of which are herein incorporated by reference in its entirety, such as, but not limited to, SEQ ID NOs: 1-9 of U.S. Pat. No. 6,509,150.

In one embodiment, the adeno-associated virus sequence may be any of the AAV vector related sequences described in U.S. Pat. No. 6,521,426, the contents of which are herein incorporated by reference in its entirety, such as, but not limited to, SEQ ID NOs: 1-4 of U.S. Pat. No. 6,521,426.

In one embodiment, the adeno-associated virus sequence may be any of the AAV vector related sequences described in U.S. Pat. No. 6,582,692, the contents of which are herein incorporated by reference in its entirety, such as, but not limited to, SEQ ID NOs: 1, 3, 5, 7 and 9-16 of U.S. Pat. No. 6,582,692.

In one embodiment, the adeno-associated virus sequence may be any of the AAV vector related sequences described in U.S. Pat. No. 6,642,051, the contents of which are herein incorporated by reference in its entirety, such as, but not limited to, SEQ ID NOs: 1-5 of U.S. Pat. No. 6,642,051.

In one embodiment, the adeno-associated virus sequence may be any of the AAV vector related sequences described in U.S. Pat. No. 6,670,176, the contents of which are herein incorporated by reference in its entirety, such as, but not limited to, SEQ ID NOs: 1-20 of U.S. Pat. No. 6,670,176.

In one embodiment, the adeno-associated virus sequence may be any of the AAV vector related sequences described in U.S. Pat. No. 6,710,036, the contents of which are herein incorporated by reference in its entirety, such as, but not limited to, SEQ ID NOs: 1-6 of U.S. Pat. No. 6,710,036.

In one embodiment, the adeno-associated virus sequence may be any of the AAV vector related sequences described in U.S. Pat. No. 6,723,551, the contents of which are herein incorporated by reference in its entirety, such as, but not limited to, SEQ ID NOs: 1-3, 5-24 of U.S. Pat. No. 6,723,551.

In one embodiment, the adeno-associated virus sequence may be any of the AAV vector related sequences described in U.S. Pat. No. 6,846,665, the contents of which are herein incorporated by reference in its entirety, such as, but not limited to, SEQ ID NOs: 1 and 2 of U.S. Pat. No. 6,846,665.

In one embodiment, the adeno-associated virus sequence may be any of the AAV vector related sequences described in U.S. Pat. No. 6,897,045, the contents of which are herein incorporated by reference in its entirety, such as, but not limited to, SEQ ID NOs: 1-14 of U.S. Pat. No. 6,897,045.

In one embodiment, the adeno-associated virus sequence may be any of the AAV vector related sequences described in U.S. Pat. No. 7,070,998, the contents of which are herein incorporated by reference in its entirety, such as, but not limited to, SEQ ID NOs: 1-3 of U.S. Pat. No. 7,070,998.

In one embodiment, the adeno-associated virus sequence may be any of the sequences related to AAV1 described in U.S. Pat. No. 7,105,345, the contents of which are herein incorporated by reference in its entirety, such as, but not limited to, SEQ ID NOs: 1, 4, 6, 8, 10, 12, 14, 16 and 18-20 of U.S. Pat. No. 7,105,345.

In one embodiment, the adeno-associated virus sequence may be any of the AAV vector related sequences described in U.S. Pat. No. 7,125,705, the contents of which are herein incorporated by reference in its entirety, such as, but not limited to, SEQ ID NOs: 1-28 of U.S. Pat. No. 7,125,705.

In one embodiment, the adeno-associated virus sequence may be any of the sequences related to AAV1 described in U.S. Pat. No. 7,186,552, the contents of which are herein incorporated by reference in its entirety, such as, but not limited to, SEQ ID NOs: 1, 4, 6, 8, 10, 12, 14, 16 and 18-20 of U.S. Pat. No. 7,186,552.

In one embodiment, the adeno-associated virus sequence may be any of the sequences related to AAV9 described in U.S. Pat. No. 7,198,951, the contents of which are herein incorporated by reference in its entirety, such as, but not limited to, SEQ ID NO: 1 of U.S. Pat. No. 7,198,951.

In one embodiment, the adeno-associated virus sequence may be any of the AAV vector related sequences described in U.S. Pat. No. 7,241,447, the contents of which are herein incorporated by reference in its entirety, such as, but not limited to, SEQ ID NOs: 1-13 of U.S. Pat. No. 7,241,447.

In one embodiment, the adeno-associated virus sequence may be any of the AAV vector related sequences described in U.S. Pat. No. 7,271,002, the contents of which are herein incorporated by reference in its entirety, such as, but not limited to, SEQ ID NOs: 1-3, 5-24 and 33-35 of U.S. Pat. No. 7,271,002.

In one embodiment, the adeno-associated virus sequence may be any of the AAV vector related sequences described in U.S. Pat. No. 7,510,872, the contents of which are herein incorporated by reference in its entirety, such as, but not limited to, SEQ ID NOs: 1-3 of U.S. Pat. No. 7,510,872.

In one embodiment, the adeno-associated virus sequence may be any of the pseudotyped AAV vector related sequences described in U.S. Pat. No. 7,638,120, the contents of which are herein incorporated by reference in its entirety, such as, but not limited to, SEQ ID NOs: 1-15 of U.S. Pat. No. 7,638,120.

In one embodiment, the adeno-associated virus sequence may be any of the AAV vector related sequences described in U.S. Pat. No. 7,662,627, the contents of which are herein incorporated by reference in its entirety, such as, but not limited to, SEQ ID NOs: 1-3 of U.S. Pat. No. 7,662,627.

In one embodiment, the adeno-associated virus sequence may be any of the AAV vector related sequences described in U.S. Pat. No. 7,803,622, the contents of which are herein incorporated by reference in its entirety, such as, but not limited to, SEQ ID NOs: 1-14 of U.S. Pat. No. 7,803,622.

In one embodiment, the adeno-associated virus sequence may be any of the AAV vector related sequences described in U.S. Pat. No. 7,906,111, the contents of which are herein incorporated by reference in its entirety, such as, but not limited to, SEQ ID NOs: 1-82, 165-180, 182, and 199-215 of U.S. Pat. No. 7,906,111.

In one embodiment, the adeno-associated virus sequence may be any of the AAV vector related sequences described in U.S. Pat. No. 8,241,622, the contents of which are herein incorporated by reference in its entirety, such as, but not limited to, SEQ ID NOs: 1-11 of U.S. Pat. No. 8,241,622.

In one embodiment, the adeno-associated virus sequence may be any of the AAV vector related sequences described in U.S. Pat. No. 8,273,344, the contents of which are herein incorporated by reference in its entirety, such as, but not limited to, SEQ ID NOs: 1-5 of U.S. Pat. No. 8,273,344.

In one embodiment, the adeno-associated virus sequence may be any of the AAV vector related sequences described in U.S. Pat. No. 8,283,151, the contents of which are herein incorporated by reference in its entirety, such as, but not limited to, SEQ ID NOs: 1-20, 31-34 and 39-53 of U.S. Pat. No. 8,283,151.

In one embodiment, the adeno-associated virus sequence may be any of the AAV vector related sequences described in U.S. Pat. No. 8,318,687, the contents of which are herein incorporated by reference in its entirety, such as, but not limited to, SEQ ID NOs: 1, 3, 5, 7, 9 and 11-19 of U.S. Pat. No. 8,318,687.

In one embodiment, the adeno-associated virus sequence may be any of the AAV vector related sequences described in U.S. Pat. No. 8,409,842, the contents of which are herein incorporated by reference in its entirety, such as, but not limited to, SEQ ID NOs: 1-3 of U.S. Pat. No. 8,409,842.

In one embodiment, the adeno-associated virus sequence may be any of the AAV vector related sequences described in U.S. Pat. No. 8,524,446, the contents of which are herein incorporated by reference in its entirety, such as, but not limited to, SEQ ID NOs: 1, 4-59 and 116-120 of U.S. Pat. No. 8,524,446.

In one embodiment, the adeno-associated virus sequence may be any of the AAV vector related sequences described in International Patent Publication No. WO2004111250, the contents of which are herein incorporated by reference in its entirety, such as, but not limited to, SEQ ID NOs: 1-14 of International Patent Publication No. WO2004111250.

In one embodiment, the adeno-associated virus sequence may be any of the AAV vector related sequences described in International Patent Publication No. WO2000066780, the contents of which are herein incorporated by reference in its entirety, such as, but not limited to, SEQ ID NOs: 1-98 of International Patent Publication No. WO2000066780.

In one embodiment, the adeno-associated virus sequence may be any of the AAV vector related sequences described in International Patent Publication No. WO2001025465, the contents of which are herein incorporated by reference in its entirety, such as, but not limited to, SEQ ID NOs: 1-98 of International Patent Publication No. WO2001025465.

In one embodiment, the adeno-associated virus sequence may be any of the sequences related to AAV REP78 described in International Patent Publication No. WO2001032711, the contents of which are herein incorporated by reference in its entirety, such as, but not limited to, SEQ ID NO: 5 of International Patent Publication No. WO2001032711.

In one embodiment, the adeno-associated virus sequence may be any of the sequences related to AAV REP78 described in International Patent Publication No. WO2007130519, the contents of which are herein incorporated by reference in its entirety, such as, but not limited to, SEQ ID NO: 29-88 and 233-241 of International Patent Publication No. WO2007130519.

In one embodiment, the adeno-associated virus sequence may be any of the sequences related to AAV REP78 described in International Patent Publication No. WO2007148971, the contents of which are herein incorporated by reference in its entirety, such as, but not limited to, SEQ ID NO: 7 and 10 of International Patent Publication No. WO2007148971.

In one embodiment, the adeno-associated virus sequence may be any of the AAV vector related sequences described in International Patent Publication No. WO2001036603, the contents of which are herein incorporated by reference in its entirety, such as, but not limited to, SEQ ID NOs: 1, 3, 5, 7, and 9-16 of International Patent Publication No. WO2001036603.

In one embodiment, the adeno-associated virus sequence may be any of the ecdysone-inducible AAV vector related sequences described in International Patent Publication No. WO2001036623, the contents of which are herein incorporated by reference in its entirety, such as, but not limited to, SEQ ID NOs: 1-8 of International Patent Publication No. WO2001036623.

In one embodiment, the adeno-associated virus sequence may be any of the chimeric capsid vector related sequences described in International Patent Publication No. WO2001068888, the contents of which are herein incorporated by reference in its entirety, such as, but not limited to, SEQ ID NOs: 1, 3-6 of International Patent Publication No. WO2001068888.

In one embodiment, the adeno-associated virus sequence may be any of the AAV vector related sequences described in International Patent Publication No. WO2002012525, the contents of which are herein incorporated by reference in its entirety, such as, but not limited to, SEQ ID NOs: 1-3, 5 and 6 of International Patent Publication No. WO2002012525.

In one embodiment, the adeno-associated virus sequence may be any of the AAV vector related sequences described in International Patent Publication No. WO2002020748, the contents of which are herein incorporated by reference in its entirety, such as, but not limited to, SEQ ID NOs: 4-6 of International Patent Publication No. WO2002020748.

In one embodiment, the adeno-associated virus sequence may be any of the AAV vector related sequences described in International Patent Publication No. WO2003010320, the contents of which are herein incorporated by reference in its entirety, such as, but not limited to, SEQ ID NOs: 1-5 of International Patent Publication No. WO2003010320.

In one embodiment, the adeno-associated virus sequence may be any of the AAV vector related sequences described in International Patent Publication No. WO2003087382, the contents of which are herein incorporated by reference in its entirety, such as, but not limited to, SEQ ID NO: 1 of International Patent Publication No. WO2003087382.

In one embodiment, the adeno-associated virus sequence may be any of the AAV vector related sequences described in International Patent Publication No. WO2003087383, the contents of which are herein incorporated by reference in its entirety, such as, but not limited to, SEQ ID NOs: 1-12 of International Patent Publication No. WO2003087383.

In one embodiment, the adeno-associated virus sequence may be any of the AAV vector related sequences described in International Patent Publication No. WO1999053084, the contents of which are herein incorporated by reference in its entirety, such as, but not limited to, SEQ ID NOs: 1-4 of International Patent Publication No. WO1999053084.

In one embodiment, the adeno-associated virus sequence may be any of the AAV vector related sequences described in International Patent Publication No. WO2004075861, the contents of which are herein incorporated by reference in its entirety, such as, but not limited to, SEQ ID NOs: 1-3 of International Patent Publication No. WO2004075861.

In one embodiment, the adeno-associated virus sequence may be any of the AAV vector related sequences described in International Patent Publication No. WO2004083441, the contents of which are herein incorporated by reference in its entirety, such as, but not limited to, SEQ ID NOs: 1, 4, 6, 8, 10, 12, 14, 16, 18-20 and 54-56 of International Patent Publication No. WO2004083441.

In one embodiment, the adeno-associated virus sequence may be any of the AAV vector related sequences such as the AAV7 or AAV8 related sequences described in International Patent Publication No. WO2004108922, the contents of which are herein incorporated by reference in its entirety, such as, but not limited to, SEQ ID NOs: 7 and 8 of International Patent Publication No. WO2004108922.

In one embodiment, the adeno-associated virus sequence may be any of the AAV vector related sequences described in International Patent Publication No. WO2004111248, the contents of which are herein incorporated by reference in its entirety, such as, but not limited to, SEQ ID NOs: 1-6 of International Patent Publication No. WO2004111248.

In one embodiment, the adeno-associated virus sequence may be any of the AAV vector related sequences described in International Patent Publication No. WO2005012537, the contents of which are herein incorporated by reference in its entirety, such as, but not limited to, SEQ ID NO: 11 of International Patent Publication No. WO2005012537.

In one embodiment, the adeno-associated virus sequence may be any of the AAV vector related sequences described in International Patent Publication No. WO2005033321, the contents of which are herein incorporated by reference in its entirety, such as, but not limited to, SEQ ID NOs: 1-82, 165-180, 182 and 199-215 of International Patent Publication No. WO2005033321.

In one embodiment, the adeno-associated virus sequence may be any of the AAV vector related sequences described in International Patent Publication No. WO2005111220, the contents of which are herein incorporated by reference in its entirety, such as, but not limited to, SEQ ID NOs: 1-11 of International Patent Publication No. WO2005111220.

In one embodiment, the adeno-associated virus sequence may be any of the AAV vector related sequences described in International Patent Publication No. WO2006110689, the contents of which are herein incorporated by reference in its entirety, such as, but not limited to, SEQ ID NOs: 7 and 11-19 of International Patent Publication No. WO2006110689.

In one embodiment, the adeno-associated virus sequence may be any of the AAV vector related sequences described in International Patent Publication No. WO2007046703, the contents of which are herein incorporated by reference in its entirety, such as, but not limited to, SEQ ID NO: 7 of International Patent Publication No. WO2007046703.

In one embodiment, the adeno-associated virus sequence may be any of the vector related sequences described in International Patent Publication No. WO2009014445, the contents of which are herein incorporated by reference in its entirety, such as, but not limited to, SEQ ID NOs: 1-5, 7, 9 and 10 of International Patent Publication No. WO2009014445.

In one embodiment, the adeno-associated virus sequence may be any of the AAV vector related sequences described in International Patent Publication No. WO2009038462, the contents of which are herein incorporated by reference in its entirety, such as, but not limited to, SEQ ID NOs: 1 and 2 of International Patent Publication No. WO2009038462.

In one embodiment, the adeno-associated virus sequence may be any of the optimized rep or capsid related sequences described in International Patent Publication No. WO2009104964, the contents of which are herein incorporated by reference in its entirety, such as, but not limited to, SEQ ID NOs: 1-5, 7, 9, 20, 22, 24 and 31 of International Patent Publication No. WO2009104964.

In one embodiment, the adeno-associated virus sequence may be any of the AAV vector related sequences described in International Patent Publication No. WO2011054976, the contents of which are herein incorporated by reference in its entirety, such as, but not limited to, SEQ ID NOs: 15 and 16 of International Patent Publication No. WO2011054976.

In one embodiment, the adeno-associated virus sequence may be any of the AAV vector related sequences described in International Patent Publication No. WO2011122950, the contents of which are herein incorporated by reference in its entirety, such as, but not limited to, SEQ ID NO: 10 of International Patent Publication No. WO2011122950.

In one embodiment, the adeno-associated virus sequence may be any of the AAV vector related sequences described in International Patent Publication No. WO2012057363, the contents of which are herein incorporated by reference in its entirety, such as, but not limited to, SEQ ID NOs: 1-22 of International Patent Publication No. WO2012057363.

In one embodiment, the adeno-associated virus sequence may be any of the AAV vector related sequences described in International Patent Publication No. WO2012114090, the contents of which are herein incorporated by reference in its entirety, such as, but not limited to, SEQ ID NOs: 1, 8 and 9 of International Patent Publication No. WO2012114090.

In one embodiment, the adeno-associated virus sequence may be any of the capsid free AAV vector related sequences described in International Patent Publication No. WO2012123430, the contents of which are herein incorporated by reference in its entirety, such as, but not limited to, SEQ ID NOs: 1-6 of International Patent Publication No. WO2012123430.

In one embodiment, the adeno-associated virus sequence may be any of the AAV vector related sequences described in International Patent Publication No. WO2012158757, the contents of which are herein incorporated by reference in its entirety, such as, but not limited to, SEQ ID NOs: 1-6 of International Patent Publication No. WO2012158757.

In one embodiment, the adeno-associated virus sequence may be any of the AAV vector related sequences described in International Patent Publication No. WO2013164793, the contents of which are herein incorporated by reference in its entirety, such as, but not limited to, SEQ ID NOs: 9, 17, 18 and 20 of International Patent Publication No. WO2013164793.

In one embodiment, the adeno-associated virus sequence may be any of the AAV vector related sequences described in International Patent Publication No. WO1995011997, the contents of which are herein incorporated by reference in its entirety, such as, but not limited to, SEQ ID NOs: 1-9 of International Patent Publication No. WO1995011997.

In one embodiment, the adeno-associated virus sequence may be any of the AAV vector related sequences described in International Patent Publication No. WO1999027110, the contents of which are herein incorporated by reference in its entirety, such as, but not limited to, SEQ ID NOs: 1-11 of International Patent Publication No. WO1999027110.

In one embodiment, the adeno-associated virus sequence may be any of the AAV vector related sequences or adenovirus chimeric recombinant viruses described in International Patent Publication No. WO1999032647, the contents of which are herein incorporated by reference in its entirety, such as, but not limited to, SEQ ID NOs: 1-12 of International Patent Publication No. WO1999032647.

In one embodiment, the adeno-associated virus sequence may be any of the sequences described in Japanese patent application numbers JP 2001169777 (see e.g., SEQ ID NO: 1-7), JP 2001500497 (see e.g., SEQ ID NO: 1-4), JP 2001520051 (see e.g., SEQ ID NO: 1-5), JP 2001526900 (see e.g., SEQ ID NO: 1-12), JP 2002153278 (see e.g., SEQ ID NO: 5, 6), JP 2002515257 (see e.g., SEQ ID NO: 1-7), JP 2002516345 (see e.g., SEQ ID NO: 1-6), JP 2002529098 (see e.g., SEQ ID NO: 1-11), JP 2002542805 (see e.g., SEQ ID NO: 1-98), JP 2003174896 (see e.g., SEQ ID NO: 1), JP 2003235562 (see e.g., SEQ ID NO: 1-63), JP 2003501006 (see e.g., SEQ ID NO: 1, 2), JP 2003507063 (see e.g., SEQ ID NO: 1, 11), JP 2003507063 (see e.g., SEQ ID NO: 2-10, 12, 13), JP 2003526377 (see e.g., SEQ ID NO: 1-5), JP 2003531166 (see e.g., SEQ ID NO: 1-5), JP 2003533170 (see e.g., SEQ ID NO: 1-13), JP 2004506658 (see e.g., SEQ ID NO: 1), JP 2004508041 (see e.g., SEQ ID NO: 1-6), JP 2004532822 (see e.g., SEQ ID NO: 1-11), JP 2005021149 (see e.g., SEQ ID NO: 1-14), JP 2005512533 (see e.g., SEQ ID NO: 1), JP 2005516949 (see e.g., SEQ ID NO: 1-3), JP 2005522517 (see e.g., SEQ ID NO: 1-12), JP 2005522994 (see e.g., SEQ ID NO: 1), JP 2005525086 (see e.g., SEQ ID NO: 1-63), JP 2006518187 (see e.g., SEQ ID NO: 3), JP 2007082565 (see e.g., SEQ ID NO: 1-3), JP 2007507223 (see e.g., SEQ ID NO: 1-116), JP 2007524386 (see e.g., SEQ ID NO: 11, 12, 15), JP 2007527219 (see e.g., SEQ ID NO: 1-22), JP 2008506363 (see e.g., SEQ ID NO: 1-11), JP 2009195237 (see e.g., SEQ ID NO: 1-6, 7-57, 60-63), JP 2009512436 (see e.g., SEQ ID NO: 7), JP 2010273690 (see e.g., SEQ ID NO: 11, 12, 15), JP 2010534472 (see e.g., SEQ ID NO: 1-8), JP 2010538675 (see e.g., SEQ ID NO: 1, 2), JP 2011101646 (see e.g., SEQ ID NO: 1, 3, 98-104, 112, 114, 115), JP 2011101646 (see e.g., SEQ ID NO: 2, 4-97, 105-113, 116), JP 2011254821 (see e.g., SEQ ID NO: 1), JP 2012165744 (see e.g., SEQ ID NO: 1, 3-16), JP 2012175974 (see e.g., SEQ ID NO: 1-116), JP 2012503980 (see e.g., SEQ ID NO: 7, 8), JP 2012519008 (see e.g., SEQ ID NO: 1-19, 23-34, 59-61, 82-87, 100, 101), JP 2012521750 (see e.g., SEQ ID NO: 3, 4), JP 2012525150 (see e.g., SEQ ID NO: 1-34), JP 2013509890 (see e.g., SEQ ID NO: 1, 2), JP 2013529063 (see e.g., SEQ ID NO: 14) and JP 2014012013 (see e.g., SEQ ID NO: 7, 10), and Korean patent application numbers KR 1019997001915 (see e.g., SEQ ID NO: 1-4), KR 1020027004803 (see e.g., SEQ ID NO: 1), KR 1020030092680 (see e.g., SEQ ID NO: 1-13), KR 1020040054043 (see e.g., SEQ ID NO: 1-5), KR 1020047007245 (see e.g., SEQ ID NO: 1, 4-53, 55-59, 115-120), KR 1020050067661 (see e.g., SEQ ID NO: 1-15), KR 1020050067662 (see e.g., SEQ ID NO: 1-11), KR 1020057008410 (see e.g., SEQ ID NO: 5), KR 1020057023896 (see e.g., SEQ ID NO: 1, 3, 5, 7, 9, 11-19), KR 1020100094020 (see e.g., SEQ ID NO: 9-33), KR 1020110086553 (see e.g., SEQ ID NO: 11, 12) and KR 1020120089743 (see e.g., SEQ ID NO: 15, 16), the contents of each of which are herein incorporated by reference in their entirety.

Inverted Terminal Repeats (ITRs)

AAV ITR nucleotide sequence comprise a palindromic sequence, comprising complementary, symmetrically arranged sequences referred to as "A," "B," and "C" regions. The ITR functions as an origin of replication comprising recognition sites for replication proteins Rep78 or Rep68. The "D" region of the ITR is an asymmetrical region of the ITR that comprises the DNA nick site at the junction between the A and D regions where DNA replication initiates and provides directionality to the nucleic acid replication step. An AAV replicating in a mammalian cell typically comprises two ITR sequences.

A single ITR may be engineered with Rep binding sites on both strands of the A regions and two symmetrical D regions on each side of the ITR palindrome. Such an engineered construct on a double-stranded circular DNA template allows Rep78 or Rep68 initiated nucleic acid replication that proceeds in both directions. A single ITR is sufficient for AAV replication of a circular vector.

According to the present invention, the payload construct vector may comprise an even number of two or more ITR sequences. In some embodiments, the payload construct vector comprises one ITR sequence. In some embodiments, the payload construct vector comprises two ITR sequences.

Methods of producing viral vectors described herein may comprise methods to prevent further propagation after initial introduction into a target cell. Safety of viral vectors may also be improved by using a viral expression construct comprising nucleotide sequences encoding a chimeric ITR. In this instance, a payload construct vector comprising a chimeric ITR may only be replicated by the Rep or Rep protein equivalent which is capable of binding the chimeric ITR. A chimeric ITR may comprise a binding site for a Rep protein or Rep protein equivalent and a nicking site. In one embodiment, a chimeric ITR of the viral expression construct comprises a binding site which is specific for the insect Rep protein, NS-1.

In one embodiment of the invention, the payload construct vector comprises at least one chimeric ITR nucleotide sequence comprising an AAV backbone and a specific binding and nicking site of a Rep protein from a parvovirus other than AAV, a nucleotide sequence encoding a parvoviral Rep protein that can specifically bind and nick the site in the ITR nucleotide sequence within the viral expression construct.

In one embodiment, the chimeric ITR is the AAV2/JcDNV ITR sequence and the nucleotide sequence encoding Rep coding sequence is that of NS-1.

In one embodiment, the adeno-associated virus sequence may be any of the ITR sequences described in European Patent Application No. EP2524037, the contents of which are herein incorporated by reference in its entirety, such as, but not limited to, SEQ ID NOs: 1-12 of European Patent Application No. EP2524037.

Rep Genes

AAV Rep sequences are highly conserved among many AAV variants. Rep78 proteins of the variants AAV2, AAV3A, AAV3B, AAV4, and AAV6 are approximately 89-93% identical (Bantel-Schaal et al., (1999) *J. Virol.*, 73(2):939-947, the contents of which are herein incorporated by reference in its entirety). The Rep gene sequences of many AAV variants are known to functionally substitute corresponding sequences from other variants in production of AAV particles in mammalian cells. In one embodiment, a Rep protein equivalent derived from a parvovirus other than AAV is the non-structural protein NS-1 from *Junonia coenia* densovirus (JcDNV) as described in U.S. Pat. No. 7,271,002, the contents of which are herein incorporated by reference in its entirety. The NS-1 protein has been shown to have binding/nicking and ATP-dependent helicase activities closely matching those of AAV Rep78 and Rep68 (Ding et al., *J. Virol.*, 76(1):338-345 2002, the contents of which is herein incorporated by reference in its entirety). In one embodiment, a binding site for NS-1 comprising four repeats of a GAC sequence may be engineered into the viral expression construct of the invention.

Rep78 and Rep68 function in two distinct roles as part of a replication mechanism known as 'rolling hairpin replication' that is characteristic of Rep proteins from parvoviruses. Rep78 and Rep68 comprise both exonuclease activity and DNA helicase activity. Either Rep78 and/or Rep68 bind to unique and known sites on the sequence of the ITR hairpin. These binding sites comprise short and repeated nucleotide sequences located on the A region of the ITR hairpin, and nick the DNA backbone at the beginning of the D region. In a second mode of activity, Rep78 or Rep68 exerts an ATP-dependent helicase activity for unwinding double-stranded DNA. Consequently, Rep78 and Rep68 act to break and unwind the hairpin structures on the end of the parvoviral genome, thereby providing access to replication machinery of the viral replication cell.

According to the present invention, Rep proteins may be expressed from more than one ORF comprising nucleotide sequence encoding any combination of Rep78, Rep68, Rep 52 and/or Rep40 by use of separate nucleotide sequences operably linked to at least one expression control sequence for expression in a viral replication cell, each producing one or more of Rep78, Rep68, Rep 52 and/or Rep40 Rep proteins.

In one embodiment, Rep proteins may be expressed individually from an ORF comprising nucleotide sequence encoding any one of Rep78, Rep68, Rep 52, or Rep40 by use of separate nucleotide sequences operably linked to one expression control sequence for expression in a viral replication cell, each producing only one Rep78, Rep68, Rep 52, or Rep40 Rep protein.

In another embodiment, Rep proteins may be expressed from one ORF comprising nucleotide sequences encoding Rep78 and Rep52 Rep proteins operably linked to at least one expression control sequence for expression in a viral replication cell each producing Rep78 and Rep52 Rep protein.

In other embodiments, Parvovirus Rep proteins or the equivalents thereof, which specifically bind ITRs, nick single-stranded DNA, and display ATP-dependent helicase activity may be employed. In one embodiment, chimeric ITRs using binding sites and nick sequences for other parvoviruses may be constructed for viral expression constructs having an AAV backbone.

Nucleic acid sequences encoding one or more AAV Rep proteins useful in the present invention are disclosed in Table 7. Such sequences may be further engineered in any manner taught herein.

embodiment, VP proteins may be expressed individually from an ORF comprising nucleotide sequence encoding any one of VP1, VP2, or VP3 by use of separate nucleotide sequences operably linked to one expression control sequence for expression in a viral replication cell, each producing only one of VP1, VP2, or VP3 capsid protein. In another embodiment, VP proteins may be expressed from one ORF comprising nucleotide sequences encoding VP1, VP2, and VP3 capsid proteins operably linked to at least one expression control sequence for expression in a viral replication cell, each producing VP1, VP2, and VP3 capsid protein.

The Cap gene sequence, and the protein sequences that comprise the VP proteins VP1, VP2, VP3 that the Cap gene encodes, are less conserved than other AAV viral components, including the Rep gene and proteins. VP proteins comprise the capsid of the viral vector, the outermost surface

TABLE 7

Adeno-Associated Virus Rep Protein Encoding Sequences

| Description | Accession Number/ GI Number | SEQ ID NO | Region encoding the Rep protein (Accession Number/ GI Number of protein) |
|---|---|---|---|
| Duck parvovirus clone 04Nb REP gene, complete cds. | (DQ250134.1/ GI:82468918) | 72 | 1-1884 (ABB76814.1/GI:82468919) |
| Goose parvovirus strain HG5/82 NS protein (ns) gene, complete cds. | (AY506546.1/ GI:40795863) | 73 | 1-1884 (AAR91602.1/GI:40795864) |
| Goose parvovirus strain HBZF07 NS1 (NS1) gene, complete cds. | (EU022755.1/ GI:154201542) | 74 | 1-1884 (ABS71119.1/GI:154201543) |
| Goose parvovirus strain LN-1/06 non-structural protein (NS) gene, complete cds. | (EU253479.1/ GI:160415348) | 75 | 1-1884 (ABX38993.1/GI:160415349) |
| Peromyscus adeno-associated virus M-6/USA/2010 nonstructural protein gene, partial cds | (JF755424.1/ GI:343196983) | 76 | 1-220 (AEM05828.1/GI:343196984) |
| Peromyscus adeno-associated virus M-6/USA/2010 nonstructural protein gene, partial cds | (JF755425.1/ GI:343196985) | 77 | 1-422 (AEM05829.1/GI:343196986) |
| Peromyscus adeno-associated virus M-6/USA/2010 nonstructural protein gene, partial cds | (JF755426.1/ GI:343196987) | 78 | 1-280 (AEM05830.1/GI:343196988) |
| Goose parvovirus strain H1 non-structural protein 1 (NS1) gene, complete cds. | (JQ409356.1/ GI:385215215) | 79 | 1-1884 (AFI49447.1/GI:385215216) |

In one embodiment, the adeno-associated virus sequence may be any of the Rep sequences described in U.S. Pat. No. 6,753,419, the contents of which are herein incorporated by reference in its entirety, such as, but not limited to, SEQ ID NOs: 1-11 of U.S. Pat. No. 6,753,419.

Capsid genes

The naturally occurring AAV Cap gene expresses VP1, VP2, and VP3 proteins encoded by a single open reading frame of the Cap gene under control of the p40 promoter. In the production system of the invention, one or more ORFs may comprise nucleotide sequences encoding one or more capsid proteins. These proteins may be encoded on the viral expression construct. In one embodiment, VP proteins may be expressed from more than one ORF comprising nucleotide sequence encoding any combination of VP1, VP2, and/or VP3 by use of separate nucleotide sequences operably linked to at least one expression control sequence for expression in a viral replication cell, each producing one or more of VP1, VP2, and/or VP3 capsid proteins. In one of the viral vector, and therefore are the primary determinant of cellular tropism of the viral vector. The highly conserved sequences of the Rep and ITR genes allow for cross-complementation of Rep and ITR sequences with the Cap sequences of other AAV variants. As a non-limiting example, the Rep and ITR sequences of one or more AAV variants may be combined with the Cap sequences from any AAV variant. In one embodiment, a viral vector may be produced, according to the invention, encoding the Rep sequences of AAV2 and the Cap sequences of AAV4. The viral vector may further comprises proteins expressed from a payload construct vector encoding the ITR sequences from AAV2.

The overall decreased conservation of the Cap nucleotide sequence, as compared to the Rep and ITR nucleotide sequences, described between AAV variants is often confined to discrete variable regions (VR). Variable regions in the Cap nucleotide sequence may encode discrete regions of the mature folded capsid proteins of the viral vector particle.

Variation of the viral vector at regions that contact cellular proteins may regulate the virus-cell interactions that define the tropism of a single AAV variant. In some embodiments, AAV variants are defined by VR of the Cap genes, VP1, VP2, and/or VP3.

As used herein, tropism refers to a property of AAV wherein AAV variants may preferentially transduce a subset of organisms, tissues, or cell types.

The protein subunit structure of capsid proteins is comprised of secondary structures such as helices and beta sheets. A group of beta-sheets may further comprise a tertiary structure known in the art as a beta barrel. In a non-limiting example, an AAV2 capsid subunit may comprise a beta barrel further comprised of beta sheets A, B, C, D, E, F, G, H, and I (Xi et al. PNAS 2002 Aug. 6; 99(16):10405-10, the contents of which are herein incorporated by reference in their entirety). Beta sheet subunits may be connected by loop structures that extend away from the main beta sheet barrel and are commonly named by the adjacent beta sheets. In a non-limiting example, an AAV2 beta barrel may comprise beta sheets H and I which are connected by an HI loop. In some embodiments, AAV variants are defined by VR of structural elements, including but not limited to the HI loop.

Nucleic acid sequences encoding one or more AAV capsid proteins useful in the present invention are disclosed in Table 8. Such sequences may be further engineered in any manner taught herein.

TABLE 8

Adeno-Associated Virus Capsid Sequences

| Description | Accession Number/ GI Number | SEQ ID NO | Region encoding the capsid protein (Accession Number/ GI Number of protein) |
|---|---|---|---|
| Adeno-associated virus 9 isolate hu.14 capsid protein VP1 (cap) gene, complete cds | AY530579.1/ GI:46487804 | 80 | 1-2211 (AAS99264.1/GI:46487805) |
| Adeno-associated virus isolate pi.1 capsid protein VP1 (cap) gene, complete cds | AY530553.1/ GI:46487752 | 81 | 1-2196 (AAS99238.1/GI:46487753) |
| Adeno-associated virus isolate pi.2 capsid protein VP1 (cap) gene, complete cds | AY530554.1/ GI:46487754 | 82 | 1-2196 (AAS99239.1/GI:46487755) |
| Adeno-associated virus isolate pi.3 capsid protein VP1 (cap) gene, complete cds | AY530555.1/ GI:46487756 | 83 | 1-2196 (AAS99240.1/GI:46487757) |
| Adeno-associated virus isolate rh.1 capsid protein VP1 (cap) gene, complete cds | AY530556.1/ GI:46487758 | 84 | 1-2214 (AAS99241.1/GI:46487759) |
| Adeno-associated virus isolate rh.25 capsid protein VP1 (cap) gene, complete cds | AY530557.1/ GI:46487760 | 85 | 1-2217 (AAS99242./GI:46487761) |
| Adeno-associated virus isolate rh.38 capsid protein VP1 (cap) gene, complete cds | AY530558.1/ GI:46487762 | 86 | 1-2217 (AAS99243.1/GI:46487763) |
| Adeno-associated virus isolate rh.40 capsid protein VP1 (cap) gene, complete cds | AY530559.1/ GI:46487764 | 87 | 1-2217 (AAS99244.1/GI:46487765) |
| Adeno-associated virus isolate rh.43 capsid protein VP1 (cap) gene, complete cds | AY530560.1/ GI:46487766 | 88 | 1-2211 (AAS99245.1/GI:46487767) |
| Adeno-associated virus isolate rh.48 capsid protein VP1 (cap) gene, complete cds | AY530561.1/ GI:46487768 | 89 | 1-2214 (AAS99246.1/GI:46487769) |
| Adeno-associated virus isolate rh.49 capsid protein VP1 (cap) gene, complete cds | AY530562.1/ GI:46487770 | 90 | 1-2217 (AAS99247.1/GI:46487771) |
| Adeno-associated virus isolate rh.50 capsid protein VP1 (cap) gene, complete cds | AY530563.1/ GI:46487772 | 91 | 1-2217 (AAS99248.1/GI:46487773) |
| Adeno-associated virus isolate rh.51 capsid protein VP1 (cap) gene, complete cds | AY530564.1/ GI:46487774 | 92 | 1-2217 (AAS99249.1/GI:46487775) |
| Adeno-associated virus isolate rh.52 capsid protein VP1 (cap) gene, complete cds | AY530565.1/ GI:46487776 | 93 | 1-2217 (AAS99250.1/GI:46487777) |
| Adeno-associated virus isolate rh.53 capsid protein VP1 (cap) gene, complete cds | AY530566.1/ GI:46487778 | 94 | 1-2217 (AAS99251.1/GI:46487779) |
| Adeno-associated virus isolate rh.54 capsid protein VP1 (cap) gene, complete cds | AY530567.1/ GI:46487780 | 95 | 1-2214 (AAS99252.1/GI:46487781) |
| Adeno-associated virus isolate rh.55 capsid protein VP1 (cap) gene, complete cds | AY530568.1/ GI:46487782 | 96 | 1-2214 (AAS99253.1/GI:46487783) |
| Adeno-associated virus isolate rh.57 capsid protein VP1 (cap) gene, complete cds | AY530569.1/ GI:46487784 | 97 | 1-2217 (AAS99254.1/GI:46487785) |

TABLE 8-continued

Adeno-Associated Virus Capsid Sequences

| Description | Accession Number/ GI Number | SEQ ID NO | Region encoding the capsid protein (Accession Number/ GI Number of protein) |
|---|---|---|---|
| Adeno-associated virus isolate rh.58 capsid protein VP1 (cap) gene, complete cds | AY530570.1/ GI:46487786 | 98 | 1-2217 (AAS99255.1/GI:46487787) |
| Adeno-associated virus isolate rh.60 capsid protein VP1 (cap) gene, complete cds | AY530571.1/ GI:46487788 | 99 | 1-2208 (AAS99256.1/GI:46487789) |
| Adeno-associated virus isolate rh.61 capsid protein VP1 (cap) gene, complete cds | AY530572.1/ GI:46487790 | 100 | 1-2217 (AAS99257.1/GI:46487791) |
| Adeno-associated virus isolate rh.62 capsid protein VP1 (cap) gene, complete cds | AY530573.1/ GI:46487792 | 101 | 1-2214 (AAS99258.1/GI:46487793) |
| Adeno-associated virus isolate rh.64 capsid protein VP1 (cap) gene, complete cds | AY530574.1/ GI:46487794 | 102 | 1-2217 (AAS99259.1/GI:46487795) |
| Adeno-associated virus isolate hu.1 capsid protein VP1 (cap) gene, complete cds | AY530575.1/ GI:46487796 | 103 | 1-2208 (AAS99260.1/GI:46487797) |
| Adeno-associated virus isolate hu.10 capsid protein VP1 (cap) gene, complete cds | AY530576.1/ GI:46487798 | 104 | 1-2208 (AAS99261.1/GI:46487799) |
| Adeno-associated virus isolate hu.11 capsid protein VP1 (cap) gene, complete cds | AY530577.1/ GI:46487800 | 105 | 1-2208 (AAS99262.1/GI:46487801) |
| Adeno-associated virus isolate hu.13 capsid protein VP1 (cap) gene, complete cds | AY530578.1/ GI:46487802 | 106 | 1-2208 (AAS99263.1/GI:46487803) |
| Adeno-associated virus isolate hu.15 capsid protein VP1 (cap) gene, complete cds | AY530580.1/ GI:46487806 | 107 | 1-2208 (AAS99265.1/GI:46487807) |
| Adeno-associated virus isolate hu.16 capsid protein VP1 (cap) gene, complete cds | AY530581.1/ GI:46487808 | 108 | 1-2208 (AAS99266.1/GI:46487809) |
| Adeno-associated virus isolate hu.17 capsid protein VP1 (cap) gene, complete cds | AY530582.1/ GI:46487810 | 109 | 1-2217 (AAS99267.1/GI:46487811) |
| Adeno-associated virus isolate hu.18 capsid protein VP1 (cap) gene, complete cds | AY530583.1/ GI:46487812 | 110 | 1-2208 (AAS99268.1/GI:46487813) |
| Adeno-associated virus isolate hu.19 capsid protein VP1 (cap) gene, complete cds | AY530584.1/ GI:46487814 | 111 | 1-2208 (AAS99269.1/GI:46487815) |
| Adeno-associated virus isolate hu.2 capsid protein VP1 (cap) gene, complete cds | AY530585.1/ GI:46487816 | 112 | 1-2208 (AAS99270.1/GI:46487817) |
| Adeno-associated virus isolate hu.20 capsid protein VP1 (cap) gene, complete cds | AY530586.1/ GI:46487818 | 113 | 1-2208 (AAS99271.1/GI:46487819) |
| Adeno-associated virus isolate hu.21 capsid protein VP1 (cap) gene, complete cds | AY530587.1/ GI:46487820 | 114 | 1-2208 (AAS99272.1/GI:46487821) |
| Adeno-associated virus isolate hu.22 capsid protein VP1 (cap) gene, complete cds | AY530588.1/ GI:46487822 | 115 | 1-2208 (AAS99273.1/GI:46487823) |
| Adeno-associated virus isolate hu.23 capsid protein VP1 (cap) gene, complete cds | AY530589.1/ GI:46487824 | 116 | 1-2208 (AAS99274.1/GI:46487825) |
| Adeno-associated virus isolate hu.24 capsid protein VP1 (cap) gene, complete cds | AY530590.1/ GI:46487826 | 114 | 1-2208 (AAS99275.1/GI:46487827) |
| Adeno-associated virus isolate hu.25 capsid protein VP1 (cap) gene, complete cds | AY530591.1/ GI:46487828 | 117 | 1-2208 (AAS99276.1/GI:46487829) |
| Adeno-associated virus isolate hu.27 capsid protein VP1 (cap) gene, complete cds | AY530592.1/ GI:46487830 | 118 | 1-2208 (AAS99277.1/GI:46487831) |
| Adeno-associated virus isolate hu.28 capsid protein VP1 (cap) gene, complete cds | AY530593.1/ GI:46487832 | 119 | 1-2208 (AAS99278.1/GI:46487833) |
| Adeno-associated virus isolate hu.29 capsid protein VP1 (cap) gene, complete cds | AY530594.1/ GI:46487834 | 120 | 1-2208 (AAS99279.1/GI:46487835) |

TABLE 8-continued

Adeno-Associated Virus Capsid Sequences

| Description | Accession Number/ GI Number | SEQ ID NO | Region encoding the capsid protein (Accession Number/ GI Number of protein) |
|---|---|---|---|
| Adeno-associated virus isolate hu.3 capsid protein VP1 (cap) gene, complete cds | AY530595.1/ GI:46487836 | 121 | 1-2211 (AAS99280.1/GI:46487837) |
| Adeno-associated virus isolate hu.31 capsid protein VP1 (cap) gene, complete cds | AY530596.1/ GI:46487838 | 122 | 1-2211 (AAS99281.1/GI:46487839) |
| Adeno-associated virus isolate hu.32 capsid protein VP1 (cap) gene, complete cds | AY530597.1/ GI:46487840 | 123 | 1-2211 (AAS99282.1/GI:46487841) |
| Adeno-associated virus isolate hu.34 capsid protein VP1 (cap) gene, complete cds | AY530598.1/ GI:46487842 | 124 | 1-2208 (AAS99283.1/GI:46487843) |
| Adeno-associated virus isolate hu.35 capsid protein VP1 (cap) gene, complete cds | AY530599.1/ GI:46487844 | 125 | 1-2208 (AAS99284.1/GI:46487845) |
| Adeno-associated virus isolate hu.37 capsid protein VP1 (cap) gene, complete cds | AY530600.1/ GI:46487846 | 126 | 1-2217 (AAS99285.1/GI:46487847) |
| Adeno-associated virus isolate hu.39 capsid protein VP1 (cap) gene, complete cds | AY530601.1/ GI:46487848 | 127 | 1-2217 (AAS99286.1/GI:46487849) |
| Adeno-associated virus isolate hu.4 capsid protein VP1 (cap) gene, complete cds | AY530602.1/ GI:46487850 | 128 | 1-2208 (AAS99287.1/GI:46487851) |
| Adeno-associated virus isolate hu.40 capsid protein VP1 (cap) gene, complete cds | AY530603.1/ GI:46487852 | 129 | 1-2217 (AAS99288.1/GI:46487853) |
| Adeno-associated virus isolate hu.41 capsid protein VP1 (cap) gene, complete cds | AY530604.1/ GI:46487854 | 130 | 1-2217 (AAS99289.1/GI:46487855) |
| Adeno-associated virus isolate hu.42 capsid protein VP1 (cap) gene, complete cds | AY530605.1/ GI:46487856 | 131 | 1-2217 (AAS99290.1/GI:46487857) |
| Adeno-associated virus isolate hu.43 capsid protein VP1 (cap) gene, complete cds | AY530606.1/ GI:46487858 | 132 | 1-2214 (AAS99291.1/GI:46487859) |
| Adeno-associated virus isolate hu.44 capsid protein VP1 (cap) gene, complete cds | AY530607.1/ GI:46487860 | 133 | 1-2211 (AAS99292.1/GI:46487861) |
| Adeno-associated virus isolate hu.45 capsid protein VP1 (cap) gene, complete cds | AY530608.1/ GI:46487862 | 134 | 1-2208 (AAS99293.1/GI:46487863) |
| Adeno-associated virus isolate hu.46 capsid protein VP1 (cap) gene, complete cds | AY530609.1/ GI:46487864 | 135 | 1-2211 (AAS99294.1/GI:46487865) |
| Adeno-associated virus isolate hu.47 capsid protein VP1 (cap) gene, complete cds | AY530610.1/ GI:46487866 | 136 | 1-2208 (AAS99295.1/GI:46487867) |
| Adeno-associated virus isolate hu.48 capsid protein VP1 (cap) gene, complete cds | AY530611.1/ GI:46487868 | 137 | 1-2211 (AAS99296.1/GI:46487869) |
| Adeno-associated virus isolate hu.49 capsid protein VP1 (cap) gene, complete cds | AY530612.1/ GI:46487870 | 138 | 1-2208 (AAS99297.1/GI:46487871) |
| Adeno-associated virus isolate hu.51 capsid protein VP1 (cap) gene, complete cds | AY530613.1/ GI:46487872 | 139 | 1-2208 (AAS99298.1/GI:46487873) |
| Adeno-associated virus isolate hu.52 capsid protein VP1 (cap) gene, complete cds | AY530614.1/ GI:46487874 | 140 | 1-2208 (AAS99299.1/GI:46487875) |
| Adeno-associated virus isolate hu.53 capsid protein VP1 (cap) gene, complete cds | AY530615.1/ GI:46487876 | 141 | 1-2205 (AAS99300.1/GI:46487877) |
| Adeno-associated virus isolate hu.54 capsid protein VP1 (cap) gene, complete cds | AY530616.1/ GI:46487878 | 142 | 1-2205 (AAS99301.1/GI:46487879) |
| Adeno-associated virus isolate hu.55 capsid protein VP1 (cap) gene, complete cds | AY530617.1/ GI:46487880 | 143 | 1-2205 (AAS99302.1/GI:46487881) |
| Adeno-associated virus isolate hu.56 capsid protein VP1 (cap) gene, complete cds | AY530618.1/ GI:46487882 | 144 | 1-2208 (AAS99303.1/GI:46487883) |

TABLE 8-continued

Adeno-Associated Virus Capsid Sequences

| Description | Accession Number/ GI Number | SEQ ID NO | Region encoding the capsid protein (Accession Number/ GI Number of protein) |
|---|---|---|---|
| Adeno-associated virus isolate hu.57 capsid protein VP1 (cap) gene, complete cds | AY530619.1/ GI:46487884 | 145 | 1-2205 (AAS99304.1/GI:46487885) |
| Adeno-associated virus isolate hu.58 capsid protein VP1 (cap) gene, complete cds | AY530620.1/ GI:46487886 | 146 | 1-2208 (AAS99305.1/GI:46487887) |
| Adeno-associated virus isolate hu.6 capsid protein VP1 (cap) gene, complete cds | AY530621.1/ GI:46487888 | 147 | 1-2217 (AAS99306.1/GI:46487889) |
| Adeno-associated virus isolate hu.60 capsid protein VP1 (cap) gene, complete cds | AY530622.1/ GI:46487890 | 148 | 1-2208 (AAS99307.1/GI:46487891) |
| Adeno-associated virus isolate hu.61 capsid protein VP1 (cap) gene, complete cds | AY530623.1/ GI:46487892 | 149 | 1-2208 (AAS99308.1/GI:46487893) |
| Adeno-associated virus isolate hu.63 capsid protein VP1 (cap) gene, complete cds | AY530624.1/ GI:46487894 | 150 | 1-2208 (AAS99309.1/GI:46487895) |
| Adeno-associated virus isolate hu.64 capsid protein VP1 (cap) gene, complete cds | AY530625.1/ GI:46487896 | 151 | 1-2208 (AAS99310.1/GI:46487897) |
| Adeno-associated virus isolate hu.66 capsid protein VP1 (cap) gene, complete cds | AY530626.1/ GI:46487898 | 152 | 1-2217 (AAS99311.1/GI:46487899) |
| Adeno-associated virus isolate hu.67 capsid protein VP1 (cap) gene, complete cds | AY530627.1/ GI:46487900 | 153 | 1-2217 (AAS99312.1/GI:46487901) |
| Adeno-associated virus isolate hu.7 capsid protein VP1 (cap) gene, complete cds | AY530628.1/ GI:46487902 | 154 | 1-2208 (AAS99313.1/GI:46487903) |
| Adeno-associated virus isolate hu.9 capsid protein VP1 (cap) gene, complete cds | AY530629.1/ GI:46487904 | 155 | 1-2208 (AAS99314.1/GI:46487905) |
| Adeno-associated virus isolate hu.T17 capsid protein VP1 (cap) gene, complete cds | AY695370.1/ GI:51512230 | 156 | 1-2208 (AAU05358.1/GI:51512231) |
| Adeno-associated virus isolate hu.LG15 capsid protein VP1 (cap) gene, complete cds | AY695377.1/ GI:51512250 | 157 | 1-2208 (AAU05371.1/GI:51512251) |
| Adeno-associated virus isolate hu.T41 capsid protein VP1 (cap) gene, complete cds | AY695378.1/ GI:51512252 | 158 | 1-2208 (AAU05372.1/GI:51512253) |
| Adeno-associated virus isolate AAVpo6 capsid protein VP1 gene, complete cds | JX896664.1/ GI:429842375 | 159 | 1-2181 (AGA15924.1/GI:429842376) |
| Adeno-associated virus isolate AAVpo2.1 capsid protein VP1 gene, complete cds | JX896665.1/ GI:429842377 | 160 | 1-2181 (AGA15925.1/GI:429842378) |
| Adeno-associated virus isolate AAVpo5 capsid protein VP1 gene, complete cds | JX896666.1/ GI:429842379 | 161 | 1-2151 (AGA15926.1/GI:429842380) |
| Adeno-associated virus isolate AAVpo4 capsid protein VP1 gene, complete cds | JX896667.1/ GI:429842381 | 162 | 1-2184 (AGA15927.1/GI:429842382) |
| Adeno-associated virus capsid protein gene, partial cds | AY683556.1/ GI:56418346 | 163 | 1-201 (AAV90981.1/GI:56418347) |
| Adeno-associated virus capsid protein gene, partial cds | AY683557.1/ GI:56418348 | 164 | 1-201 (AAV90982.1/GI:56418349) |
| Adeno-associated virus capsid protein gene, partial cds | AY683558.1/ GI:56418350 | 165 | 1-201 (AAV90983.1/GI:56418351) |
| Adeno-associated virus isolate AAV6.1 capsid protein VP1 gene, partial cds | EU368909.1/ GI:171850122 | 166 | 1-2208 (ACB55301.1/GI:171850123) |
| Adeno-associated virus isolate AAV6.2 capsid protein VP1 gene, partial cds | EU368910.1/ GI:171850124 | 167 | 1-2208 (ACB55302.1/GI:171850125) |
| Adeno-associated virus isolate AAV6R2 capsid protein VP1 gene, partial cds | EU368911.1/ GI:171850126 | 168 | 1-2208 (ACB55303.1/GI:171850127) |
| Adeno-associated virus isolate ch.5R capsid protein VP1 gene, partial cds | EU368912.1/ GI:171850128 | 169 | 1-2205 (ACB55304.1/GI:171850129) |

TABLE 8-continued

Adeno-Associated Virus Capsid Sequences

| Description | Accession Number/ GI Number | SEQ ID NO | Region encoding the capsid protein (Accession Number/ GI Number of protein) |
|---|---|---|---|
| Adeno-associated virus isolate cy.1R1 capsid protein VP1 gene, partial cds | EU368913.1/ GI:171850130 | 170 | 1-2184 (ACB55305.1/GI:171850131) |
| Adeno-associated virus isolate cy.5R4 capsid protein VP1 gene, partial cds | EU368914.1/ GI:171850132 | 171 | 1-2184 (ACB55306.1/GI:171850133) |
| Adeno-associated virus isolate hu.29r capsid protein VP1 gene, partial cds | EU368915.1/ GI:171850134 | 172 | 1-2205 (ACB55307.1/GI:171850135) |
| Adeno-associated virus isolate hu.44R2 capsid protein VP1 gene, partial cds | EU368916.1/ GI:171850136 | 173 | 1-2208 (ACB55308.1/GI:171850137) |
| Adeno-associated virus isolate hu.44r3 capsid protein VP1 gene, partial cds | EU368917.1/ GI:171850138 | 174 | 1-2208 (ACB55309.1/GI:171850139) |
| Adeno-associated virus isolate hu.48R3 capsid protein VP1 gene, partial cds | EU368918.1/ GI:171850140 | 175 | 1-2208 (ACB55310.1/GI:171850141) |
| Adeno-associated virus isolate rh.2R capsid protein VP1 gene, partial cds | EU368919.1/ GI:171850142 | 176 | 1-2214 (ACB55311.1/GI:171850143) |
| Adeno-associated virus isolate rh.37R2 capsid protein VP1 gene, partial cds | EU368920.1/ GI:171850144 | 177 | 1-2187 (ACB55312.1/GI:171850145) |
| Adeno-associated virus isolate rh.39 capsid protein VP1 gene, partial cds | EU368921.1/ GI:171850146 | 178 | 1-2214 (ACB55313.1/GI:171850147) |
| Adeno-associated virus isolate rh.46 capsid protein VP1 gene, partial cds | EU368922.1/ GI:171850148 | 179 | 1-2214 (ACB55314.1/GI:171850149) |
| Adeno-associated virus isolate rh.48R2 capsid protein VP1 gene, partial cds | EU368923.1/ GI:171850150 | 180 | 1-2211 (ACB55315.1/GI:171850151) |
| Adeno-associated virus isolate rh.64R1 capsid protein VP1 gene, partial cds | EU368924.1/ GI:171850152 | 181 | 1-2214 (ACB55316.1/GI:171850153) |
| Adeno-associated virus isolate rh.8R capsid protein VP1 gene, partial cds | EU368925.1/ GI:171850154 | 182 | 1-2208 (ACB55317.1/GI:171850155) |
| Adeno-associated virus isolate rh32.33 capsid protein VP1 gene, partial cds | EU368926.1/ GI:171850156 | 183 | 1-2199 (ACB55318.1/GI:171850157) |
| Adeno-associated virus - Po2 VP1 gene, partial cds | FJ688148.1/ GI:224384443 | 184 | 1-1338 (ACN42944.1/GI:224384444) |
| Adeno-associated virus - Po3 VP1 gene, partial cds | FJ688146.1/ GI:224384436 | 185 | 1-1500 (ACN42939.1/GI:224384437) |
| Adeno-associated virus 9 isolate hu.14 capsid protein VP1 (cap), complete cds | AY530579.1/ GI:46487804 | 80 | 1-2211 (AAS99264.1/GI:46487805) |
| Caprine adeno-associated virus 1 isolate AAV-Go.1 capsid protein (cap) gene, complete cds | AY724675.1/ GI:52630844 | 186 | 1-2181 (AAU84890.1/GI:52630845) |
| Bat adeno-associated virus isolate 1008-HB-Mr capsid protein (cap) gene, partial cds | GU226879.1/ GI:290467598 | 187 | 1-447 (ADD26594.1/GI:290467599) |
| Bat adeno-associated virus isolate 1019-HB-Rs capsid protein (cap) gene, partial cds | GU226880.1/ GI:290467600 | 188 | 1-462 (ADD26595.1/GI:290467601) |
| Bat adeno-associated virus isolate 1199-HN-Ra capsid protein (cap) gene, partial cds | GU226881.1/ GI:290467602 | 189 | 1-447 (ADD26596.1/GI:290467603) |
| Bat adeno-associated virus isolate 1203-HN-Ra capsid protein (cap) gene, partial cds | GU226882.1/ GI:290467604 | 190 | 1-447 (ADD26597.1/GI:290467605) |
| Bat adeno-associated virus isolate 1285-YN-Mr capsid protein (cap) gene, partial cds | GU226883.1/ GI:290467606 | 191 | 1-462 (ADD26598.1/GI:290467607) |
| Bat adeno-associated virus isolate 1288-YN-Mr capsid protein (cap) gene, partial cds | GU226884.1/ GI:290467608 | 192 | 1-456 (ADD26599.1/GI:290467609) |
| Bat adeno-associated virus isolate 1296-YN-Mr capsid protein (cap) gene, partial cds | GU226885.1/ GI:290467610 | 193 | 1-456 (ADD26600.1/GI:29046761) |

TABLE 8-continued

Adeno-Associated Virus Capsid Sequences

| Description | Accession Number/ GI Number | SEQ ID NO | Region encoding the capsid protein (Accession Number/ GI Number of protein) |
|---|---|---|---|
| Bat adeno-associated virus isolate 1297-YN-Md capsid protein (cap) gene, partial cds | GU226886.1/ GI:290467612 | 194 | 1-456 (ADD26601.1/GI:290467613) |
| Bat adeno-associated virus isolate 1298-YN-Mr capsid protein (cap) gene, partial cds | GU226887.1/ GI:290467614 | 195 | 1-456 (ADD26602.1/GI:290467615) |
| Bat adeno-associated virus isolate 1330-YN-Mis capsid protein (cap) gene, partial cds | GU226888.1/ GI:290467616 | 195 | 1-456 (ADD26603.1/GI:290467617) |
| Bat adeno-associated virus isolate 1339-YN-Mr capsid protein (cap) gene, partial cds | GU226889.1/ GI:290467618 | 195 | 1-456 (ADD26604.1/GI:290467619) |
| Bat adeno-associated virus isolate 1356-YN-Mis capsid protein (cap) gene, partial cds | GU226890.1/ GI:290467620 | 196 | 1-456 (ADD26605.1/GI:290467621) |
| Bat adeno-associated virus isolate 1361-YN-Md capsid protein (cap) gene, partial cds | GU226891.1/ GI:290467622 | 196 | 1-456 (ADD26606.1/GI:290467623) |
| Bat adeno-associated virus isolate 1445-GD-Rs capsid protein (cap) gene, partial cds | GU226892.1/ GI:290467624 | 197 | 1-444 (ADD26607.1/GI:290467625) |
| Bat adeno-associated virus isolate 1451-GD-Rs capsid protein (cap) gene, partial cds | GU226893.1/ GI:290467626 | 198 | 1-444 (ADD26608.1/GI:290467627) |
| Bat adeno-associated virus isolate 1454-GD-Rs capsid protein (cap) gene, partial cds | GU226894.1/ GI:290467628 | 199 | 1-444 (ADD26609.1/GI:290467629) |
| Bat adeno-associated virus isolate 1491-GD-Sk capsid protein (cap) gene, partial cds | GU226895.1/ GI:290467630 | 200 | 1-462 (ADD26610.1/GI:290467631) |
| Bat adeno-associated virus isolate 1497-GD-Sk capsid protein (cap) gene, partial cds | GU226896.1/ GI:290467632 | 201 | 1-462 (ADD26611.1/GI:290467633) |
| Bat adeno-associated virus isolate 1503-GD-Sk capsid protein (cap) gene, partial cds | GU226897.1/ GI:290467634 | 202 | 1-462 (ADD26612.1/GI:290467635) |
| Bat adeno-associated virus isolate 1512-GD-Sk capsid protein (cap) gene, partial cds | GU226898.1/ GI:290467636 | 203 | 1-462 (ADD26613.1/GI:290467637) |
| Bat adeno-associated virus isolate 1514-GD-Sk capsid protein (cap) gene, partial cds | GU226899.1/ GI:290467638 | 204 | 1-453 (ADD26614.1/GI:290467639) |
| Bat adeno-associated virus isolate 1519-GD-Hl capsid protein (cap) gene, partial cds | GU226900.1/ GI:290467640 | 205 | 1-453 (ADD26615.1/GI:290467641) |
| Bat adeno-associated virus isolate 973-HB-Mr capsid protein (cap) gene, partial cds | GU226901.1/ GI:290467642 | 206 | 1-456 (ADD26616.1/GI:290467643) |
| Bat adeno-associated virus isolate 986-HB-Ha capsid protein (cap) gene, partial cds | GU226902.1/ GI:290467644 | 207 | 1-453 (ADD26617.1/GI:290467645) |
| Bat adeno-associated virus isolate 1003-HB-Mr capsid protein (cap) gene, partial cds | GU226903.1/ GI:290467646 | 206 | 1-456 (ADD26618.1/GI:290467647) |
| Bat adeno-associated virus isolate 1053-TJ-Mr capsid protein (cap) gene, partial cds | GU226904.1/ GI:290467648 | 208 | 1-456 (ADD26619.1/GI:290467649) |
| Bat adeno-associated virus isolate 1181-HN-Ra capsid protein (cap) gene, partial cds | GU226905.1/ GI:290467650 | 187 | 1-447 (ADD26620.1/GI:290467651) |
| Bat adeno-associated virus isolate 1280-YN-Rm capsid protein (cap) gene, partial cds | GU226906.1/ GI:290467652 | 209 | 1-444 (ADD26621.1/GI:290467653) |
| Bat adeno-associated virus isolate 1345-YN-Md capsid protein (cap) gene, partial cds | GU226907.1/ GI:290467654 | 210 | 1-456 (ADD26622.1/GI:290467655) |
| Bat adeno-associated virus isolate 1357-YN-Mis capsid protein (cap) gene, partial cds | GU226908.1/ GI:290467656 | 211 | 1-456 (ADD26623.1/GI:290467657) |
| Bat adeno-associated virus isolate 1372-YN-Ha capsid protein (cap) gene, partial cds | GU226909.1/ GI:290467658 | 212 | 1-462 (ADD26624.1/GI:290467659) |

TABLE 8-continued

Adeno-Associated Virus Capsid Sequences

| Description | Accession Number/ GI Number | SEQ ID NO | Region encoding the capsid protein (Accession Number/ GI Number of protein) |
|---|---|---|---|
| Bat adeno-associated virus isolate 1396-YN-Ra capsid protein (cap) gene, partial cds | GU226910.1/ GI:290467660 | 213 | 1-444 (ADD26625.1/GI:290467661) |
| Bat adeno-associated virus isolate 1399-YN-Ra capsid protein (cap) gene, partial cds | GU226911.1/ GI:290467662 | 214 | 1-444 (ADD26626.1/GI:290467663) |
| Bat adeno-associated virus isolate 1441-GD-Ra capsid protein (cap) gene, partial cds | GU226912.1/ GI:290467664 | 215 | 1-444 (ADD26627.1/GI:290467665) |
| Bat adeno-associated virus isolate 1534-GD-Hl capsid protein (cap) gene, partial cds | GU226913.1/ GI:290467666 | 216 | 1-453 (ADD26628.1/GI:290467667) |
| Bat adeno-associated virus isolate 1596-HB-Rs capsid protein (cap) gene, partial cds | GU226914.1/ GI:290467668 | 217 | 1-444 (ADD26629.1/GI:290467669) |
| Bat adeno-associated virus isolate 1710-HB-Mr capsid protein (cap) gene, partial cds | GU226915.1/ GI:290467670 | 218 | 1-456 (ADD26630.1/GI:290467671) |
| Bat adeno-associated virus isolate 1721-HB-Rs capsid protein (cap) gene, partial cds | GU226916.1/ GI:290467672 | 219 | 1-456 (ADD26631.1/GI:290467673) |
| Bat adeno-associated virus isolate 1167-HN-Ra-A capsid protein (cap) gene, partial cds | HQ142870.1/ GI:304323342 | 220 | 1-447 (ADM24808.1/GI:304323343) |
| Bat adeno-associated virus isolate 1167-HN-Ra-B capsid protein (cap) gene, partial cds | HQ142871.1/ GI:304323344 | 221 | 1-444 (ADM24809.1/GI:304323345) |
| Bat adeno-associated virus isolate 1302-YN-Mr-A capsid protein (cap) gene, partial cds | HQ142872.1/ GI:304323346 | 222 | 1-456 (ADM24810.1/GI:304323347) |
| Bat adeno-associated virus isolate 1302-YN-Mr-B capsid protein (cap) gene, partial cds | HQ142873.1/ GI:304323348 | 223 | 1-462 (ADM24811.1/GI:304323349) |
| Bat adeno-associated virus isolate 1354-YN-Mr-A capsid protein (cap) gene, partial cds | HQ142874.1/ GI:304323350 | 224 | 1-456 (ADM24812.1/GI:304323351) |
| Bat adeno-associated virus isolate 1354-YN-Mr-B capsid protein (cap) gene, partial cds | HQ142875.1/ GI:304323352 | 225 | 1-462 (ADM24813.1/GI:304323353) |
| Bat adeno-associated virus isolate 1715-HB-Rs-A capsid protein (cap) gene, partial cds | HQ142876.1/ GI:304323354 | 226 | 1-462 (ADM24814.1/GI:304323355) |
| Bat adeno-associated virus isolate 1715-HB-Rs-B capsid protein (cap) gene, partial cds | HQ142877.1/ GI:304323356 | 227 | 1-444 (ADM24815.1/GI:304323357) |
| Bat adeno-associated virus isolate 1715-HB-Rs-C capsid protein (cap) gene, partial cds | HQ142878.1/ GI:304323358 | 228 | 1-444 (ADM24816.1/GI:304323359) |
| Bat adeno-associated virus isolate 1278-YN-Mr capsid protein (cap) gene, partial cds | HQ142879.1/ GI:304323360 | 194 | 1-456 (ADM24817.1/GI:304323361) |
| Bat adeno-associated virus isolate WOR1 capsid protein (Cap) gene, partial cds | JX863728.1/ GI:490338873 | 229 | 1-440 (AGL09967.1/GI:490338874) |
| Bat adeno-associated virus GF-4a capsid gene, partial cds | HM228878.1/ GI:297598977 | 230 | 1-500 (ADI48256.1/GI:297598978) |
| Duck parvovirus strain 90-0215 capsid protein (VP1) gene, complete cds | AY382891.1/ GI:38569531 | 231 | 1-2199 (AAR24365.1/GI:38569532) |
| Duck parvovirus strain 90-0219 capsid protein (VP1) gene, complete cds | AY382892.1/ GI:38569533 | 232 | 1-2199 (AAR24366.1/GI:38569534) |
| Duck parvovirus strain 97-0104 capsid protein (VP1) gene, complete cds | AY382893.1/ GI:38569535 | 233 | 1-2199 (AAR24367.1/GI:38569536) |
| Fox adeno-associated virus isolate F4 capsid protein (VP1) gene, partial cds | KC878874.1/ GI:484400116 | 234 | 1-1680 (AGK45557.1/GI:484400117) |
| Goose parvovirus strain 82-0308 capsid protein (VP1) gene, complete cds | AY382883.1/ GI:38569515 | 235 | 1-2199 (AAR24357.1/GI:38569516) |
| Goose parvovirus strain 82-0321 capsid protein (VP1) gene, complete cds | AY382884.1/ GI:38569517 | 236 | 1-2199 (AAR24358.1/GI:38569518) |

TABLE 8-continued

Adeno-Associated Virus Capsid Sequences

| Description | Accession Number/ GI Number | SEQ ID NO | Region encoding the capsid protein (Accession Number/ GI Number of protein) |
|---|---|---|---|
| Goose parvovirus strain 82-0321v capsid protein (VP1) gene, complete cds | AY382885.1/ GI:38569519 | 237 | 1-2199 (AAR24359.1/GI:38569520) |
| Goose parvovirus strain 82-0408 capsid protein (VP1) gene, complete cds | AY382886.1/ GI:38569521 | 238 | 1-2199 (AAR24360.1/GI:38569522) |
| Goose parvovirus strain 86-1015 capsid protein (VP1) gene, complete cds | AY382887.1/ GI:38569523 | 239 | 1-2199 (AAR24361.1/GI:38569524) |
| Goose parvovirus strain 99-0808 capsid protein (VP1) gene, complete cds | AY382888.1/ GI:38569525 | 240 | 1-2199 (AAR24362.1/GI:38569526) |
| Goose parvovirus strain 01-1001 capsid protein (VP1) gene, complete cds | AY382889.1/ GI:38569527 | 241 | 1-2199 (AAR24363.1/GI:38569528) |
| Duck parvovirus strain 90-0219v capsid protein (VP1) gene, complete cds | AY382890.1/ GI:38569529 | 242 | 1-2199 (AAR24364.1/GI:38569530) |
| Goose parvovirus strain HG5/82 VP1 (vp1) gene, complete cds; VP2 (vp2) gene, partial cds; and VP3 (vp3) gene, complete cds | AY506547.1/ GI:40795865 | 243 | 1-99 (AAR91603.1/GI:40795866) 436-2199 (AAR91604.1/GI:40795867) 595-2199 (AAR91605.1/GI:40795868) |
| Goose parvovirus strain GD capsid protein gene, complete cds | AY512830.1/ GI:42433273 | 244 | 1-2199 (AAS16481.1/GI:42433274) |
| Goose parvovirus capsid protein VP3 gene, complete cds | DQ299421.1/ GI:83320498 | 245 | 1-1605 (ABC02874.1/GI:83320499) |
| Goose parvovirus strain GD-01 capsid protein (VP3) gene, complete cds | DQ665790.1/ GI:110083950 | 246 | 1-1605 (ABG49148.1/GI:110083951) |
| Goose parvovirus strain JX capsid protein VP3 gene, complete cds | EF014899.1/ GI:116668466 | 247 | 1-1605 (ABK15506.1/GI:116668467) |
| Goose parvovirus strain FY capsid protein VP3 gene, complete cds | EF014900.1/ GI:116668468 | 248 | 1-1605 (ABK15507.1/GI:116668469) |
| Goose parvovirus strain HEB capsid protein VP3 gene, complete cds | EF014901.1/ GI:116668470 | 249 | 1-1605 (ABK15508.1/GI:116668471) |
| Goose parvovirus strain QTH capsid protein VP3 gene, complete cds | EF014902.1/ GI:116668472 | 250 | 1-1605 (ABK15509.1/GI:116668473) |
| Goose parvovirus strain ZD capsid protein VP3 gene, complete cds | EF014903.1/ GI:116668474 | 251 | 1-1605 (ABK15510.1/GI:116668475) |
| Goose parvovirus strain ZZ capsid protein VP3 gene, complete cds | EF014904.1/ GI:116668476 | 252 | 1-1605 (ABK15511.1/GI:116668477) |
| Goose parvovirus strain GB capsid protein VP3 gene, complete cds | EF014905.1/ GI:116668478 | 253 | 1-1605 (ABK15512.1/GI:116668479) |
| Goose parvovirus strain CHv-1 nucleocapsid protein (VP3) gene, complete cds | EF427928.1/ GI:126723905 | 254 | 5-1609 (ABO26866.1/GI:126723906) |
| Goose parvovirus strain HBZF07 capsid protein (VP2) gene, complete cds | EF661584.1/ GI:151176311 | 255 | 1-1764 (ABR87940.1/GI:151357339) |
| Goose parvovirus strain SCh capsid protein (VP1), capsid protein (VP2), and capsid protein (VP3) genes, complete cds | EU088101.1/ GI:156124940 | 256 | 1-2199 (ABU50780.1/GI:156124941) 436-2199 (ABU50781.1/GI:156124942) 595-2199 (ABU50782.1/GI:156124943) |
| Goose parvovirus strain DB3 capsid protein (VP1), capsid protein (VP2), and capsid protein (VP3) genes, complete cds | EU088102.1/ GI:156124944 | 257 | 1-2199 (ABU50783.1/GI:156124945) 436-2199 (ABU50784.1/GI:156124946) 595-2199 (ABU50785.1/GI:156124947) |
| Goose parvovirus strain GDFSh capsid protein (VP1), | EU088103.1/ GI:156124948 | 258 | 1-2199 (ABU50786.1/GI:156124949) |

TABLE 8-continued

Adeno-Associated Virus Capsid Sequences

| Description | Accession Number/ GI Number | SEQ ID NO | Region encoding the capsid protein (Accession Number/ GI Number of protein) |
|---|---|---|---|
| capsid protein (VP2), and capsid protein (VP3) genes, complete cds | | | 436-2199 (ABU50787.1/GI:156124950) 595-2199 (ABU50788.1/GI:156124951) |
| Goose parvovirus strain LN-01/06 capsid protein (VP3) gene, complete cds | EU218524.1/ GI:159786813 | 259 | 1-1605 (ABW98499.1/GI:159786814) |
| Goose parvovirus strain SP capsid protein (VP3) gene, complete cds | FJ158588.1/ GI:202072064 | 260 | 1-1605 (ACH95802.1/GI:202072065) |
| Goose parvovirus strain GPV/CH/HLJ01/08 capsid protein (VP3) gene, complete cds | FJ240170.1/ GI:209553937 | 261 | 1-1605 (ACI62503.1/GI:209553938) |
| Goose parvovirus strain GPV/CH/HLJ02/08 capsid protein (VP3) gene, complete cds | FJ240171.1/ GI:209553939 | 262 | 1-1605 (ACI62504.1/GI:209553940) |
| Goose parvovirus strain GPV/CH/HLJ03/08 capsid protein (VP3) gene, complete cds | FJ240172.1/ GI:209553941 | 263 | 1-1605 (ACI62505.1/GI:209553942) |
| Goose parvovirus strain ep22 capsid protein VP3 gene, complete cds | GQ392034.1/ GI:256594160 | 264 | 1-1605 (ACV03834.1/GI:256594161) |
| Goose parvovirus strain YBLJ capsid protein VP3 gene, complete cds | JN836326.1/ GI:372863692 | 265 | 1-1605 (AEX99666.1/GI:372863693) |
| Goose parvovirus strain DQ capsid protein VP3 gene, complete cds | EF014898.1/ GI:116668464 | 266 | 1-1605 (ABK15505.1/GI:116668465) |
| Muscovy duck parvovirus capsid protein gene, complete cds | AY510603.1/ GI:40846336 | 267 | 1-2199 (AAR92460.1/GI:40846337) |
| Non-human primate Adeno-associated virus isolate AAVrh.8 capsid protein (VP1) gene, complete cds | AY242997.1/ GI:29650489 | 268 | 1-2211 (AAO88183.1/GI:29650490) |
| Non-human primate Adeno-associated virus isolate AAVrh.37 capsid protein (VP1) gene, complete cds | AY242998.1/ GI:29650491 | 269 | 1-2190 (AAO88184.1/GI:29650492) |
| Non-human primate Adeno-associated virus isolate AAVrh.36 capsid protein (VP1) gene, complete cds | AY242999.1/ GI:29650493 | 270 | 1-2190 (AAO88185.1/GI:29650494) |
| Non-human primate Adeno-associated virus isolate AAVrh.35 capsid protein (VP1) gene, complete cds | AY243000.1/ GI:29650495 | 271 | 1-2190 (AAO88186.1/GI:29650496) |
| Non-human primate Adeno-associated virus isolate AAVrh.34 capsid protein (VP1) gene, complete cds | AY243001.1/ GI:29650497 | 272 | 1-2202 (AAO88187.1/GI:29650498) |
| Non-human primate Adeno-associated virus isolate AAVrh.33 capsid protein (VP1) gene, complete cds | AY243002.1/ GI:29650499 | 273 | 1-2202 (AAO88188.1/GI:29650500) |
| Non-human primate Adeno-associated virus isolate AAVrh.32 capsid protein (VP1) gene, complete cds | AY243003.1/ GI:29650501 | 274 | 1-2202 (AAO88189.1/GI:29650502) |
| Non-human primate Adeno-associated virus isolate AAVrh.24 capsid protein (VP1) gene, complete cds | AY243004.1/ GI:29650503 | 275 | 1-2202 (AAO88190.1/GI:29650504) |
| Non-human primate Adeno-associated virus isolate AAVrh.23 capsid protein (VP1) gene, complete cds | AY243005.1/ GI:29650505 | 276 | 1-2058 (AAO88191.1/GI:29650506) |
| Non-human primate Adeno-associated virus isolate AAVrh.22 capsid protein (VP1) gene, complete cds | AY243006.1/ GI:29650507 | 277 | 1-2187 (AAO88192.1/GI:29650508) |

TABLE 8-continued

Adeno-Associated Virus Capsid Sequences

| Description | Accession Number/ GI Number | SEQ ID NO | Region encoding the capsid protein (Accession Number/ GI Number of protein) |
| --- | --- | --- | --- |
| Non-human primate Adeno-associated virus isolate AAVrh.2 capsid protein (VP1) gene, complete cds | AY243007.1/ GI:29650509 | 278 | 1-2217 (AAO88193.1/GI:29650510) |
| Non-human primate Adeno-associated virus isolate AAVrh.19 capsid protein (VP1) gene, complete cds | AY243008.1/ GI:29650511 | 279 | 1-2208 (AAO88194.1 GI:29650512) |
| Non-human primate Adeno-associated virus isolate AAVrh.18 capsid protein (VP1) gene, complete cds | AY243009.1/ GI:29650513 | 280 | 1-2217 (AAO88195.1/GI:29650514) |
| Non-human primate Adeno-associated virus isolate AAVrh.17 capsid protein (VP1) gene, complete cds | AY243010.1/ GI:29650515 | 281 | 1-2196 (AAO88196.1/GI:29650516) |
| Non-human primate Adeno-associated virus isolate AAVrh.16 capsid protein (VP1) gene, complete cds | AY243011.1/ GI:29650517 | 282 | 1-2196 (AAO88197.1/GI:29650518) |
| Non-human primate Adeno-associated virus isolate AAVrh.14 capsid protein (VP1) gene, complete cds | AY243012.1/ GI:29650519 | 283 | 1-2202 (AAO88198.1/GI:29650520) |
| Non-human primate Adeno-associated virus isolate AAVrh.13 capsid protein (VP1) gene, complete cds | AY243013.1/ GI:29650521 | 284 | 1-2187 (AAO88199.1/GI:29650522) |
| Non-human primate Adeno-associated virus isolate AAVrh.12 capsid protein (VP1) gene, complete cds | AY243014.1/ GI:29650523 | 285 | 1-2202 (AAO88200.1/GI:29650524) |
| Non-human primate Adeno-associated virus isolate AAVrh.10 capsid protein (VP1) gene, complete cds | AY243015.1/ GI:29650525 | 286 | 1-2217 (AAO88201.1/GI:29650526) |
| Non-human primate Adeno-associated virus isolate AAVcy.6 capsid protein (VP1) gene, complete cds | AY243016.1/ GI:29650527 | 287 | 1-2187 (AAO88202.1/GI:29650528) |
| Non-human primate Adeno-associated virus isolate AAVcy.5 capsid protein (VP1) gene, complete cds | AY243017.1/ GI:29650529 | 288 | 1-2187 (AAO88203.1/GI:29650530) |
| Non-human primate Adeno-associated virus isolate AAVcy.4 capsid protein (VP1) gene, complete cds | AY243018.1/ GI:29650531 | 289 | 1-2187 (AAO88204.1/GI:29650532) |
| Non-human primate Adeno-associated virus isolate AAVcy.3 capsid protein (VP1) gene, complete cds | AY243019.1/ GI:29650533 | 290 | 1-2187 (AAO88205.1/GI:29650534) |
| Non-human primate Adeno-associated virus isolate AAVcy.2 capsid protein (VP1) gene, complete cds | AY243020.1/ GI:29650535 | 291 | 1-2214 (AAO88206.1/GI:29650536) |
| Non-human primate Adeno-associated virus isolate AAVch.5 capsid protein (VP1) gene, complete cds | AY243021.1/ GI:29650537 | 292 | 1-2208 (AAO88207.1/GI:29650538) |
| Non-human primate Adeno-associated virus isolate AAVbb.2 capsid protein (VP1) gene, complete cds | AY243022.1/ GI:29650539 | 293 | 1-2217 (AAO88208.1/GI:29650540) |
| Non-human primate Adeno-associated virus isolate AAVbb.1 capsid protein (VP1) gene, complete cds | AY243023.1/ GI:29650541 | 294 | 1-2217 (AAO88209.1/GI:29650542) |
| Non-human primate Adeno-associated virus isolate rh.31 capsid protein (VP1) gene, partial cds | AY243024.1/ GI:29692329 | 295 | 1-1932 (AY243024.1/GI:29692329) |

TABLE 8-continued

Adeno-Associated Virus Capsid Sequences

| Description | Accession Number/ GI Number | SEQ ID NO | Region encoding the capsid protein (Accession Number/ GI Number of protein) |
|---|---|---|---|
| Non-human primate Adeno-associated virus isolate rh.26 capsid protein (VP1) gene, partial cds | AY243025.1/ GI:29692331 | 296 | 1-1932 (AAO89501.1/GI:29692332) |
| Non-human primate Adeno-associated virus isolate rh.27 capsid protein (VP1) gene, partial cds | AY243026.1/ GI:29692333 | 297 | 1-1932 (AAO89502.1/GI:29692334) |
| Rat adeno-associated virus 1 rep gene, partial cds; and VP1 capsid, VP2 capsid, and VP3 capsid genes, complete cds | DQ100363.1/ GI:73665999 | 298 | 334-2538 (AAZ79676.1/GI:73666001) 721-2538 (AAZ79677.1/GI:73666002) 919-2538 (AAZ79678.1/GI:73666003) |
| Recombinant adeno-associated virus vector AAV-LK19 Cap protein (Cap) gene, complete cds | KC951539.1/ GI:530340506 | 299 | 1-2211 (AGT20780.1/GI:530340507) |

In one embodiment, the adeno-associated virus sequence may be any of the capsid sequences described in International Patent Publication No. WO2010127097, the contents of which are herein incorporated by reference in its entirety, such as, but not limited to, SEQ ID NOs: 5-38 of International Patent Publication No. WO2010127097.

II. Viral Vector Engineering

Chimeric Architecture

A "chimera" according to the present invention is an entity having two or more incongruous or heterogeneous parts or regions. The viral vectors of the present invention may be produced or contain chimeric polynucleotides or polypeptides, e.g., chimeric capsid proteins and/or chimeric genomes and/or chimeric ITRs and/or chimeric regulatory proteins and/or chimeric payloads. Any of the components of a polynucleotide or polypeptide may be chimeric. Further, polypeptides encoded by the payload, e.g., transgene may also be chimeric.

Chimeric molecules, whether capsids, rep proteins, regulatory molecules or proteins, ITRs or viral genomes, are meant to include the protein as well as the nucleic acid or polynucleotide encoding the chimera. As used herein, "chimeric polynucleotides" or "chimeric polypeptides" are those polymers having portions or regions which differ from a native, wild type or reference sequence in size, sequence, sequence pattern, modification pattern, modification position, modification percent or modification population and combinations of the foregoing. Modifications may be a conjugate or linked moiety, whether heterologous to the parent sequence, donor sequence, reference sequence or to the acceptor sequence. As used herein a "part" or "region" of a protein or polynucleotide is defined as any portion of the polymer which is less than the entire length of the protein or polynucleotide.

In some embodiments, any of the transgenes, polypeptides or modulatory nucleic acids of the present invention may be encoded by nucleic acid molecules. Where these nucleic acid molecules are chimeric, they are referred to as chimeric polynucleotides. Such nucleic acid molecules include, without limitation, DNA molecules, RNA molecules, polynucleotides, oligonucleotides, mRNA molecules, vectors, plasmids and the like. In some embodiments, the present invention may comprise cells programmed or generated to express nucleic acid molecules of the present invention.

In some embodiments, the chimeric polynucleotides, which may encode chimeric polypeptides, of the invention have a structure comprising Formula I.

$$5'[A_n]_x\text{-}L1\text{-}[B_o]_y\text{-}L2\text{-}[C_p]_z\text{-}L3\ 3' \quad \text{Formula I}$$

wherein:

each of A and B independently comprise a region of linked nucleosides;

C is an optional region of linked nucleosides;

n, o and p are independently an integer between 15-1000;

x and y are independently 1-200;

z is 0-5;

L1 and L2 are independently optional linker moieties, said linker moieties being either nucleic acid based or non-nucleic acid based; and L3 is an optional conjugate or an optional linker moiety, said linker moiety being either nucleic acid based or non-nucleic acid based.

In like fashion, the chimeric polypeptides of the present invention may have a structure comprising Formula II.

$$5'[E_j]_r\text{-}L1\text{-}[F_k]_s\text{-}L2\text{-}[G_l]_t\text{-}L3\ 3' \quad \text{Formula II}$$

wherein:

each of E and F independently comprise a region of linked amino acids;

G is an optional region of linked amino acids;

j, k and l are independently an integer between 15-1000;

r and s are independently 1-200;

t is 0-5;

L1 and L2 are independently optional linker moieties, said linker moieties being either amino acid based or non-amino acid based; and L3 is an optional conjugate or an optional linker moiety, said linker moiety being either amino acid based or non-amino acid based.

In some embodiments the chimeric polynucleotide of Formula I encodes one or more transgene proteins, peptides or polypeptides of interest and may encode any of the polypeptides having Formula II. Such encoded molecules may be encoded across two or more regions and may encode overlapping proteins.

Chimeric polynucleotides and/or polypeptides, including the parts or regions thereof, of the present invention may be classified as hemimers, gapmers, wingmers, or blockmers.

As used herein, a "hemimer" is chimeric polynucleotide and/or polypeptides comprising a region or part which comprises half of one pattern, percent, position or population of a sequence from one or more polynucleotides and/or polypeptides and half of a second pattern, percent, position or population sequence from one or more polynucleotides and/or polypeptides. The polynucleotide and/or polypeptides may be the same or different. Chimeric polynucleotides and/or polypeptides of the present invention may also comprise hemimer subregions. In one embodiment, a part or region is 50% of one and 50% of another.

In one embodiment the entire chimeric polynucleotide and/or polypeptide can be 50% of one and 50% of the other. Any region or part of any chimeric polynucleotide and/or polypeptide of the invention may be a hemimer. Types of hemimers include pattern hemimers, population hemimers or position hemimers. By definition, hemimers are 50:50 percent hemimers.

As used herein, a "gapmer" is a chimeric polynucleotide and/or polypeptide having at least three parts or regions with a gap between the parts or regions. The "gap" can comprise a region of linked nucleosides or a single nucleoside (or linked amino acids or amino acid) which differs from the chimeric nature of the two parts or regions flanking it. The two parts or regions of a gapmer may be the same or different from each other.

As used herein, a "wingmer" is a chimeric polynucleotide and/or polypeptide having at least three parts or regions with a gap between the parts or regions. Unlike a gapmer, the two flanking parts or regions surrounding the gap in a wingmer are the same in degree or kind. Such similarity may be in the length or number of nucleotide or amino acid units or in the origin of the part. The wings of a wingmer may be longer or shorter than the gap. The wing parts or regions may be 20, 30, 40, 50, 60 70, 80, 90 or 95% greater or shorter in length than the region which comprises the gap.

As used herein, a "blockmer" is a patterned polynucleotide and/or polypeptide where parts or regions are of equivalent size or number and type of part or subpart. Regions or subregions in a blockmer may be 50, 51, 52, 53, 54, 55, 56, 57, 58, 59, 60, 61 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 310, 320, 330, 340, 350, 360, 370, 380, 390, 400, 410, 420, 430, 440, 450, 460, 470, 480, 490 or 500, nucleosides or amino acids long.

Chimeric polynucleotides and/or polypeptides, including the parts or regions thereof, of the present invention having a polynucleotide and/or polypeptide pattern are referred to as "pattern chimeras." Pattern chimeras may also be referred to as blockmers. Pattern chimeras are those polynucleotides and/or polypeptides having a pattern of modifications within, across or among regions or parts.

Patterns of modifications within a part or region are those which start and stop within a defined region. Patterns of modifications across a part or region are those patterns which start in one part or region and end in another adjacent part or region. Patterns of modifications among parts or regions are those which begin and end in one part or region and are repeated in a different part or region, which is not necessarily adjacent to the first region or part.

The regions or subregions of pattern chimeras or blockmers may have simple alternating patterns such as ABAB [AB]n where each "A" and each "B" represent different polynucleotides and/or polypeptides. The pattern may repeat n number of times where n=3-300. Further, each A or B can represent from 1-2500 units (e.g., nucleosides) in the pattern. Patterns may also be alternating multiples such as AABBAABB[AABB]n (an alternating double multiple) or AAABBBAAABBB[AAABBB]n (an alternating triple multiple) pattern. The pattern may repeat n number of times where n=3-300.

Different patterns may also be mixed together to form a second order pattern. For example, a single alternating pattern may be combined with a triple alternating pattern to form a second order alternating pattern A'B'. One example would be [ABABAB][AAABBBAAABBB][ABABAB] [AAABBBAAABBB][ABABAB][AAABBBAAABBB], where [ABABAB] is A' and [AAABBBAAABBB] is B'. In like fashion, these patterns may be repeated n number of times, where n=3-300.

Patterns may include three or more different modifications to form an ABCABC[ABC]n pattern. These three component patterns may also be multiples, such as AABBC-CAABBCC[AABBCC]n and may be designed as combinations with other patterns such as ABCABCAABBCCABCABCAABBCC, and may be higher order patterns.

Regions or subregions of position, percent, and population patterns need not reflect an equal contribution from each type. They may form series such as "1-2-3-4", "1-2-4-8", where each integer represents the number of units of a particular type. Alternatively, they may be odd only, such as '1-3-3-1-3-1-5" or even only "2-4-2-4-6-4-8" or a mixture of both odd and even number of units such as "1-3-4-2-5-7-3-3-4".

Pattern chimeras may vary in their sequence by degree (such as those described above) or by kind (e.g., different donor sequences).

Chimeric polynucleotides and/or polypeptides, including the parts or regions thereof, of the present invention having at least one region with two or more different sequences of two or more members of the same donor sequence (e.g., AAV2, AAV8, AAV5, etc.) are referred to as "positionally modified" chimeras. Positionally modified chimeras are also referred to herein as "selective placement" chimeras or "selective placement polynucleotides and/or polypeptides."

The chimeric polynucleotides and/or polypeptides of the present invention may be structurally modified. As used herein, a "structural" modification is one in which two or more linked nucleosides or amino acids are inserted, deleted, duplicated, inverted or randomized in a chimeric polynucleotide and/or polypeptide, respectively without significant chemical modification to the nucleotides or amino acids themselves. Because chemical bonds will necessarily be broken and reformed to effect a structural modification, structural modifications are of a chemical nature and hence are chemical modifications. However, structural modifications will result in a different sequence of nucleotides and/or amino acids.

In some embodiments of the invention, the chimeric polynucleotides may encode two or more transgenes, proteins or peptides or modulatory nucleic acids.

The regions or parts of the chimeric polynucleotides and/or polypeptides of the present invention may be separated by a linker or spacer moiety. Such linkers or spaces may be nucleic acid based or non-nucleosidic or as with polypeptides may be amino acid based or non-amino acid based.

Polypeptide Design; Structural, Non-structural And Payload

Polypeptides of the invention, whether or not chimeric and whether or not structural or nonstructural, may exist as a whole polypeptide, a plurality of polypeptides or fragments of polypeptides, which independently may be encoded by one or more nucleic acids, a plurality of nucleic acids, fragments of nucleic acids or variants of any of the aforementioned. As used herein, the term "polypeptide" refers to a polymer of amino acid residues (natural or unnatural) linked together most often by peptide bonds. The term, as used herein, refers to proteins, polypeptides, and peptides of any size, structure, or function. In some instances the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides and may be associated or linked. The term polypeptide may also apply to amino acid polymers in which one or more amino acid residues are an artificial chemical analogue of a corresponding naturally occurring amino acid.

As used herein, the term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" refers to a variant which contains one or more amino acids which would mimic a native or reference sequence. For example, glutamate may serve as a mimic for phospho-threonine and/or phospho-serine. Alternatively, variant mimics may result in deactivation or in an inactivated product containing the mimic, e.g., phenylalanine may act as an inactivating substitution for tyrosine; or alanine may act as an inactivating substitution for serine. The amino acid sequences of the compounds and/or compositions of the invention may comprise naturally occurring amino acids and as such may be considered to be proteins, peptides, polypeptides, or fragments thereof. Alternatively, the polypeptides may comprise both naturally and non-naturally occurring amino acids.

As used herein, the term "amino acid sequence variant" refers to molecules with some differences in their amino acid sequences as compared to a native or starting sequence. The amino acid sequence variants may possess substitutions, deletions, and/or insertions at certain positions within the amino acid sequence. As used herein, the terms "native" or "starting" when referring to sequences are relative terms referring to an original molecule against which a comparison may be made. Native or starting sequences should not be confused with wild type sequences. Native sequences or molecules may represent the wild-type (that sequence found in nature) but do not have to be identical to the wild-type sequence.

Ordinarily, variants will possess at least about 70% homology to a native sequence, and preferably, they will be at least about 80%, more preferably at least about 90% homologous to a native sequence.

As used herein, the term "homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

As used herein, the term "homolog" as it applies to amino acid sequences is meant the corresponding sequence of other species having substantial identity to a second sequence of a second species.

As used herein, the term "analog" is meant to include polypeptide variants which differ by one or more amino acid alterations, e.g., substitutions, additions or deletions of amino acid residues that still maintain the properties of the parent polypeptide.

As used herein, the term "derivative" is used synonymously with the term "variant" and refers to a molecule that has been modified or changed in any way relative to a reference molecule or starting molecule.

The present invention contemplates several types of polypeptides which are amino acid based including variants and derivatives. These include substitutional, insertional, deletional and covalent variants and derivatives. As such, included within the scope of this invention are polypeptides and/or polypeptide compositions comprising substitutions, insertions, additions, deletions and/or covalent modifications. For example, sequence tags or amino acids, such as one or more lysines, can be added to peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to proteins are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein, the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

As used herein, the term "insertional variants" when referring to proteins are those with one or more amino acids inserted immediately adjacent to an amino acid at a particular position in a native or starting sequence. As used herein, the term "immediately adjacent" refers to an adjacent amino acid that is connected to either the alpha-carboxy or alpha-amino functional group of a starting or reference amino acid.

As used herein, the term "deletional variants" when referring to proteins, are those with one or more amino acids in the native or starting amino acid sequence removed. Ordinarily, deletional variants will have one or more amino acids deleted in a particular region of the molecule.

As used herein, the term "derivatives," as referred to herein includes variants of a native or starting protein comprising one or more modifications with organic proteinaceous or non-proteinaceous derivatizing agents, and post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed polypeptide. Glutaminyl and asparaginyl residues are frequently post-translationally deamidated to the corresponding glutamyl and aspartyl residues. Alternatively, these residues are deamidated under mildly acidic conditions. Either form of these residues may be present in the proteins used in accordance with the present invention.

Covalent derivatives specifically include fusion molecules in which proteins of the invention are covalently bonded to a non-proteinaceous polymer. The non-proteinaceous polymer ordinarily is a hydrophilic synthetic polymer, i.e. a polymer not otherwise found in nature. However, polymers which exist in nature and are produced by recombinant or in vitro methods are useful, as are polymers which are isolated from nature. Hydrophilic polyvinyl polymers fall within the scope of this invention, e.g. polyvinylalcohol and polyvinylpyrrolidone. Particularly useful are polyvinylalkylene ethers such a polyethylene glycol, or polypropylene glycol. The proteins may be linked to various non-proteinaceous polymers, such as polyethylene glycol, polypropylene glycol or polyoxyalkylenes, in the manner set forth in U.S. Pat. Nos. 4,640,835; 4,496,689; 4,301,144; 4,670,417; 4,791,192 or 4,179,337, the contents of each of which are herein incorporated by reference in its entirety.

As used herein, the term "features" when referring to proteins are defined as distinct amino acid sequence-based components of a molecule. Features of the proteins of the present invention include surface manifestations, local conformational shape, folds, loops, half-loops, domains, half-domains, sites, termini or any combination thereof.

As used herein, the term "surface manifestation" when referring to proteins refers to a polypeptide based component of a protein appearing on an outermost surface.

As used herein, the term "local conformational shape" when referring to proteins refers to a polypeptide based structural manifestation of a protein which is located within a definable space of the protein.

As used herein, the term "fold," when referring to proteins, refers to the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein, the term "turn" as it relates to protein conformation, refers to a bend which alters the direction of the backbone of a peptide or polypeptide and may involve one, two, three or more amino acid residues.

As used herein, the term "loop" when referring to proteins, refers to a structural feature of a peptide or polypeptide which reverses the direction of the backbone of a peptide or polypeptide and comprises four or more amino acid residues. Oliva et al. have identified at least 5 classes of protein loops (Oliva, B. et al., An automated classification of the structure of protein loops. J Mol Biol. 1997. 266(4):814-30, the contents of which are herein incorporated by reference in its entirety).

As used herein, the term "half-loop," when referring to proteins, refers to a portion of an identified loop having at least half the number of amino acid resides as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein, the term "domain," when referring to proteins, refers to a motif of a polypeptide having one or more identifiable structural or functional characteristics or properties (e.g., binding capacity, serving as a site for protein-protein interactions.)

As used herein, the term "half-domain," when referring to proteins, refers to a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that subdomains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein, the terms "site," as it pertains to amino acid based embodiments is used synonymously with "amino acid residue" and "amino acid side chain." A site represents a position within a peptide or polypeptide that may be modified, manipulated, altered, derivatized or varied within the polypeptide based molecules of the present invention.

As used herein, the terms "termini" or "terminus," when referring to proteins refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a component of a molecule of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involved deleting a domain would result in the alteration of the length of a molecule just as modification of a nucleic acid to encode less than a full length molecule would.

Modifications and manipulations can be accomplished by methods known in the art such as site directed mutagenesis. The resulting modified molecules may then be tested for activity using in vitro or in vivo assays such as those described herein or any other suitable screening assay known in the art.

In some embodiments, polypeptides or the polynucleotides encoding them may comprise one or more atoms that are isotopes. As used herein, the term "isotope" refers to a chemical element that has one or more additional neutrons. In some embodiments, compounds of the present invention may be deuterated. As used herein, the term "deuterate" refers to the process of replacing one or more hydrogen atoms in a substance with deuterium isotopes. Deuterium isotopes are isotopes of hydrogen. The nucleus of hydrogen contains one proton while deuterium nuclei contain both a proton and a neutron. The compounds and/or compositions of the present invention may be deuterated in order to change one or more physical property, such as stability, or to allow polypeptides and/or polynucleotides to be used in diagnostic and/or experimental applications.

Conjugates

It is contemplated by the present invention that the polynucleotides and/or polypeptides, including the viral vectors of the present invention may be complexed, conjugated or combined with one or more homologous or heterologous molecules. As used herein, the term "homologous molecule" refers to a molecule which is similar in at least one of structure or function relative to a starting molecule while a "heterologous molecule" is one that differs in at least one of structure or function relative to a starting molecule. Structural homologs are therefore molecules which may be substantially structurally similar. In some embodiments, such homologs may be identical. Functional homologs are molecules which may be substantially functionally similar. In some embodiments, such homologs may be identical.

Polynucleotides and/or polypeptides of the present invention may comprise conjugates. Such conjugates of the invention may include naturally occurring substances or ligands, such as proteins (e.g., human serum albumin (HSA), low-density lipoprotein (LDL), high-density lipoprotein (HDL), or globulin); carbohydrates (e.g., a dextran, pullulan, chitin, chitosan, inulin, cyclodextrin or hyaluronic acid); or lipids. Conjugates may also be recombinant or synthetic molecules, such as synthetic polymers, e.g., synthetic polyamino acids, an oligonucleotide (e.g. an aptamer). Examples of polyamino acids may include polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

In some embodiments, conjugates may also include targeting groups. As used herein, the term "targeting group" refers to a functional group or moiety attached to an agent that facilitates localization of the agent to a desired region, tissue, cell and/or protein. Such targeting groups may include, but are not limited to cell or tissue targeting agents or groups (e.g. lectins, glycoproteins, lipids, proteins, an antibody that binds to a specified cell type such as a kidney cell or other cell type). In some embodiments, targeting groups may comprise thyrotropins, melanotropins, lectins, glycoproteins, surfactant protein A, mucin carbohydrates, multivalent lactose, multivalent galactose, N-acetyl-galactosamine, N-acetyl-gulucosamine, multivalent mannose, multivalent fucose, glycosylated polyaminoacids, multivalent galactose, transferrin, bisphosphonate, polyglutamate, polyaspartate, lipids, cholesterol, steroids, bile acids, folates, vitamin B12, biotin, an RGD peptide, an RGD peptide mimetic or an aptamer.

In some embodiments, targeting groups may be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also comprise hormones and/or hormone receptors.

In some embodiments, targeting groups may be any ligand capable of targeting specific receptors. Examples include, without limitation, folate, GalNAc, galactose, mannose, mannose-6-phosphate, apatamers, integrin receptor ligands, chemokine receptor ligands, transferrin, biotin, serotonin receptor ligands, PSMA, endothelin, GCPII, somatostatin, LDL, and HDL ligands. In some embodiments, targeting groups are aptamers. Such aptamers may be unmodified or comprise any combination of modifications disclosed herein.

In still other embodiments, polynucleotides, polypeptides and/or the viral vectors of the present invention may be covalently conjugated to cell penetrating polypeptides. In some embodiments, cell penetrating polypeptides may also include signal sequences. In some embodiments, conjugates of the invention may be designed to have increased stability, increased cell transfection and/or altered biodistribution (e.g., targeted to specific tissues or cell types).

In some embodiments, conjugating moieties may be added to compounds and/or compositions of the present invention such that they allow the attachment of detectable labels to targets for clearance. Such detectable labels include, but are not limited to biotin labels, ubiquitins, fluorescent molecules, human influenza hemaglutinin (HA), c-myc, histidine (His), flag, glutathione S-transferase (GST), V5 (a paramyxovirus of simian virus 5 epitope), biotin, avidin, streptavidin, horse radish peroxidase (HRP) and digoxigenin.

In some embodiments, polynucleotides, polypeptides and/or the viral vectors of the present invention may be combined with one another or other molecules in the treatment of diseases and/or conditions.

III. Payload: Transgenes, Polypeptide-Encoding Polynucleotides And/Or Modulatory Nucleic Acids The payload construct vector of the present invention comprises a nucleic acid sequence encoding at least one "payload molecule" for replication in the viral replication cell and packaging within the viral vector. As used herein, a "payload molecule" refers to a transgene, a polynucleotide encoding a polypeptide or a modulatory nucleic acid. The payload molecule may comprise any nucleic acid packaged in the viral vector produced in accordance with the present invention for expression in a target cell transduced or contacted with the viral vector.

According to the present invention, the payload construct vector encodes a "payload construct." As used herein, a "payload construct" is a polynucleotide sequence encoding at least a payload molecule and sufficient ITR sequence to allow for expression of the payload molecule in a cell transduced with the viral vector.

The payload molecule may comprise a polypeptide, nucleic acid (e.g., RNA molecule), or any other gene product that is desired for expression in the target cell. The payload construct may comprise a combination of coding and non-coding nucleic acid sequences.

In one embodiment, the payload construct vector comprises more than one nucleic acid sequence encoding more than one payload molecule interest. In such an embodiment, a payload construct vector encoding more than one payload molecule may be replicated and packaged into a viral vector. A target cell transduced with a viral vector comprising more than one payload molecule may express each of the payload molecules in a single cell.

In some embodiments, the payload construct vector sequence may encode a coding or non-coding RNA.

Where the payload construct vector sequence encodes a polypeptide, the polypeptide may be a peptide or protein. A protein encoded by the payload construct vector sequence may comprise a secreted protein, an intracellular protein, an extracellular protein, and/or a membrane protein. The encoded proteins may be structural or functional. Proteins encoded by the payload construct vector or payload construct include, but are not limited to, mammalian proteins. The viral vectors encoding polypeptides (e.g., mRNA) of the invention may be used in the fields of human disease, antibodies, viruses, veterinary applications and a variety of in vivo and in vitro settings.

In some embodiments, the viral vectors are useful in the field of medicine for the treatment, palliation or amelioration of conditions or diseases such as, but not limited to, blood, cardiovascular, CNS, dermatology, endocrinology, genetic, genitourinary, gastrointestinal, musculoskeletal, oncology, and immunology, respiratory, sensory and anti-infective.

In some embodiments, viral vectors in accordance with the present invention may be used for the treatment of disease, disorders, and/or conditions, including but not limited to one or more of the following: autoimmune disorders (e.g. diabetes, lupus, multiple sclerosis, psoriasis, rheumatoid arthritis); inflammatory disorders (e.g. arthritis, pelvic inflammatory disease); neurological disorders (e.g. Alzheimer's disease, Huntington's disease; autism; Parkinson's disease); cardiovascular disorders (e.g. atherosclerosis, hypercholesterolemia, thrombosis, clotting disorders, angiogenic disorders such as macular degeneration); proliferative disorders (e.g. cancer, benign neoplasms); respiratory disorders (e.g. chronic obstructive pulmonary disease); digestive disorders (e.g. inflammatory bowel disease, ulcers); musculoskeletal disorders (e.g. fibromyalgia, arthritis); endocrine, metabolic, and nutritional disorders (e.g. diabetes, osteoporosis); urological disorders (e.g. renal disease); psychological disorders (e.g. depression, schizophrenia); skin disorders (e.g. wounds, eczema); blood and lymphatic disorders (e.g. anemia, hemophilia); etc.

In one embodiment, the disease, disorder and/or condition is a neurological disease, disorder and/or condition. As a non-limiting example, the neurological disease, disorder and/or condition is a central nervous system (CNS) disorder.

In one embodiment, the disease, disorder and/or condition treated using the viral vectors described herein is a CNS disorder. As a non-limiting example, the viral vectors which may be used to treat a CNS disorder may comprise at least one polynucleotide encoding at least one peptide sequence selected from the group consisting of VRI-VRIX and HI loop as described in FIG. 4 and VRI-CNS to VRXII-CNS as described in FIG. 6.

In one embodiment, the neurological disease, disorder and/or condition is Parkinson's disease. In one embodiment, the disease, disorder and/or condition treated using the viral vectors described herein is Parkinson's disease. As a non-limiting example, the viral vectors which may be used to treat Parkinson's disease may comprise at least one polynucleotide encoding at least one peptide sequence selected from the group consisting of VRI-VRIX and HI loop as described in FIG. 4 and VRI-CNS to VRXII-CNS as described in FIG. 6.

In another embodiment, the neurological disease, disorder and/or condition is Friedreich's Ataxia. In one embodiment, the disease, disorder and/or condition treated using the viral vectors described herein is Friedreich's Ataxia. As a non-limiting example, the viral vectors which may be used to treat Friedreich's Ataxia may comprise at least one polynucleotide encoding at least one peptide sequence selected from the group consisting of VRI-VRIX and HI loop as described in FIG. 4 and VRI-CNS to VRXII-CNS as described in FIG. 6.

In another embodiment, the neurological disease, disorder and/or condition is Amyotrophic lateral sclerosis (ALS). In one embodiment, the disease, disorder and/or condition treated using the viral vectors described herein is ALS. As a non-limiting example, the viral vectors which may be used to treat ALS may comprise at least one polynucleotide encoding at least one peptide sequence selected from the group consisting of VRI-VRIX and HI loop as described in FIG. 4 and VRI-CNS to VRXII-CNS as described in FIG. 6.

In another embodiment, the neurological disease, disorder and/or condition is Huntington's disease. In one embodiment, the disease, disorder and/or condition treated using the viral vectors described herein is Huntington's disease. As a non-limiting example, the viral vectors which may be used to treat Huntington's disease may comprise at least one polynucleotide encoding at least one peptide sequence selected from the group consisting of VRI-VRIX and HI loop as described in FIG. 4 and VRI-CNS to VRXII-CNS as described in FIG. 6.

In another embodiment, the neurological disease, disorder or condition is spinal muscular atrophy (SMA). In one embodiment, the disease, disorder and/or condition treated using the viral vectors described herein is SMA. As a non-limiting example, the viral vectors which may be used to treat SMA may comprise at least one polynucleotide encoding at least one peptide sequence selected from the group consisting of VRI-VRIX and HI loop as described in FIG. 4 and VRI-CNS to VRXII-CNS as described in FIG. 6.

In some embodiments, the payload construct encodes a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo.

Traditionally, the basic components of an mRNA molecule include at least a coding region, a 5'UTR, a 3'UTR, a 5' cap and a poly-A tail. According to the present invention, payload constructs encoding mRNA may comprise a coding region only. They may also comprise a coding region and at least one UTR. They may also comprise a coding region, 5'UTR, 3'UTR and polyA tail.

In one embodiment the polypeptide encoded by the payload construct is between 50-5000 amino acids in length. In some embodiments the protein encoded is between 50-2000 amino acids in length. In some embodiments the protein encoded is between 50-1500 amino acids in length. In some embodiments the protein encoded is between 50-1000 amino acids in length. In some embodiments the protein encoded is between 50-800 amino acids in length. In some embodiments the protein encoded is between 50-600 amino acids in length. In some embodiments the protein encoded is between 50-400 amino acids in length. In some embodiments the protein encoded is between 50-200 amino acids in length. In some embodiments the protein encoded is between 50-100 amino acids in length.

In some embodiments the peptide encoded is between 4-50 amino acids in length. In one embodiment, the shortest length of a region of the payload molecule of the present invention encoding a peptide can be the length that is sufficient to encode for a tetrapeptide, a pentapeptide, a hexapeptide, a heptapeptide, an octapeptide, a nonapeptide, or a decapeptide. In another embodiment, the length may be sufficient to encode a peptide of 2-30 amino acids, e.g. 5-30, 10-30, 2-25, 5-25, 10-25, or 10-20 amino acids. The length may be sufficient to encode for a peptide of at least 11, 12, 13, 14, 15, 17, 20, 25 or 30 amino acids, or a peptide that is no longer than 50 amino acids, e.g. no longer than 35, 30, 25, 20, 17, 15, 14, 13, 12, 11 or 10 amino acids.

An RNA encoded by the payload construct vector sequence may comprise an mRNA, tRNA, rRNA, tmRNA, miRNA, RNAi, siRNA, piRNA, shRNA antisense RNA, double stranded RNA, snRNA, snoRNA, and long non-coding RNA (ncRNA). Examples of such lncRNA molecules and RNAi constructs designed to target such lncRNA any of which may be encoded in the payload constructs are taught in International Publication, WO2012/018881, the contents of which are incorporated herein by reference in their entirety.

In one embodiment, the payload construct encodes a microRNA or miRNA as the payload molecule. These payload molecules are also referred to as modulatory nucleic acid payloads.

microRNAs (or miRNA) are 19-25 nucleotide long non-coding RNAs that bind to the 3'UTR of nucleic acid molecules and down-regulate gene expression either by reducing nucleic acid molecule stability or by inhibiting translation. The payload constructs of the invention may comprise one or more microRNA target sequences, microRNA sequences, or microRNA seeds. Such sequences may correspond to any known microRNA such as those taught in US Publication US2005/0261218 and US Publication US2005/0059005, the contents of each of which are incorporated herein by reference in their entirety.

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked by an adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105; the contents of each of which is herein incorporated by reference in their entirety. The bases of the microRNA seed have complete complementarity with the target sequence.

A payload molecule may comprise polypeptides that serve as marker proteins to assess cell transformation and expression, fusion proteins, polypeptides having a desired biological activity, gene products that can complement a genetic defect, RNA molecules, transcription factors, and other gene products that are of interest in regulation and/or expression. A payload molecule may comprise nucleotide sequences that provide a desired effect or regulatory function (e.g., transposons, transcription factors). A payload molecule may comprise, but are not limited to: hormone receptors (e.g., mineralcorticosteroid, glucocorticoid, and thyroid hormone receptors); intramembrane proteins (e.g., TM-1 and TM-7); intracellular receptors (e.g., orphans, retinoids, vitamin D3 and vitamin A receptors); signaling molecules (e.g., kinases, transcription factors, or molecules such signal transducers and activators of transcription receptors of the cytokine superfamily (e.g. erythropoietin, growth hormone, interferons, and interleukins, and colony-stimulating factors; G-protein coupled receptors, e.g., hormones, calcitonin, epinephrine, gastrin, and paracrine or autocrine mediators, such as stomatostatin or prostaglandins; neurotransmitter receptors (norepinephrine, dopamine, serotonin or acetylcholine); pathogenic antigens, which can be of viral, bacterial, allergenic, or cancerous origin; and tyrosine kinase receptors (such as insulin growth factor, and nerve growth factor).

A payload molecule may comprise a gene therapy product. A gene therapy product may comprise a polypeptide, a nucleic acid (e.g., RNA molecule), or other gene product that, when expressed in a target cell, provides a desired therapeutic effect. In some embodiments, a gene therapy product may comprise a substitute for a non-functional gene that is absent or mutated. In some embodiments, a gene therapy product may comprise a method for elimination of a gene that is over-active or dysregulated. Goldsmith et al., WO 90/07936, the contents of which are incorporated herein by reference in its entirety.

A payload construct vector encoding a payload molecule may comprise a selectable marker. A selectable marker may comprise a gene sequence or a protein encoded by that gene sequence expressed in a host cell that allows for the identification, selection, and/or purification of the host cell from a population of cells that may or may not express the selectable marker. In one embodiment the selectable marker provides resistance to survive a selection process that would otherwise kill the host cell, such as treatment with an antibiotic. In some embodiments an antibiotic selectable marker may comprise one or more antibiotic resistance factors, including but not limited to neomycin resistance (e.g., neo), hygromycin resistance, kanamycin resistance, and/or puromycin resistance.

In some embodiments a selectable marker may comprise a cell-surface marker, such as any protein expressed on the surface of the cell including, but not limited to receptors, CD markers, lectins, integrins, or truncated versions thereof. In some embodiments, cells that comprise a cell-surface marker may be selected using an antibody targeted to said cell-surface marker. In some embodiments an antibody targeted to the cell-surface marker may be directly conjugated with a selection agent including, but not limited to a fluorophore, sepharose, or magnetic bead. In some embodiments an antibody targeted to the cell-surface marker may be detected using a secondary labeled antibody or substrate which binds to the antibody targeted to the cell-surface marker. In some embodiments, a selectable marker may comprise negative selection by using an enzyme, including but not limited to Herpes simplex virus thymidine kinase (HSVTK) that converts a pro-toxin (gancyclovir) into a toxin or bacterial Cytosine Deaminase (CD) which converts the pro-toxin 5'-fluorocytosine (5'-FC) into the toxin 5'-fluorouracil (5'-FU). In some embodiments, any nucleic acid sequence encoding a polypeptide can be used as a selectable marker comprising recognition by a specific antibody.

In some embodiments, a payload construct vector encoding a payload molecule may comprise a selectable marker including, but not limited to, β-lactamase, luciferase, 0-galactosidase, or any other reporter gene as that term is understood in the art, including cell-surface markers, such as CD4 or the truncated nerve growth factor (NGFR) (for GFP, see WO 96/23810; Heim et al., *Current Biology* 2:178-182 (1996); Heim et al., *Proc. Natl. Acad. Sci. USA* (1995); or Heim et al., *Science* 373:663-664 (1995); for β-lactamase, see WO 96/30540, the contents of each of which is herein incorporated by reference in its entirety). In some embodiments, a nucleic acid encoding a selectable marker may comprise a fluorescent protein. A fluorescent protein as herein described may comprise any fluorescent marker including but not limited to green, yellow, and/or red fluorescent protein (GFP, YFP, RFP).

In accordance with the invention, a payload molecule comprising a nucleic acid for expression in a target cell will be incorporated into the viral vector produced in the viral replication cell if said payload molecule is located between two ITR sequences, or is located on either side of an asymmetrical ITR engineered with two D regions.

A payload construct vector sequence encoding one or more payload molecules for expression in a target cell may comprise one or more nucleotide sequences operably linked to at least one target cell-compatible promoter. A person skilled in the art may recognize that a target cell may require a specific promoter including but not limited to a promoter that is species specific, inducible, tissue-specific, or cell cycle-specific Parr et al., *Nat. Med.* 3:1145-9 (1997), the contents of which are herein incorporated by reference in its entirety.

IV. Viral Production viral production of the invention disclosed herein describes processes and methods for producing viral vector that contacts a target cell to deliver a payload construct, e.g. a recombinant viral construct, which comprises a nucleotide encoding a payload molecule.

Figure 2:
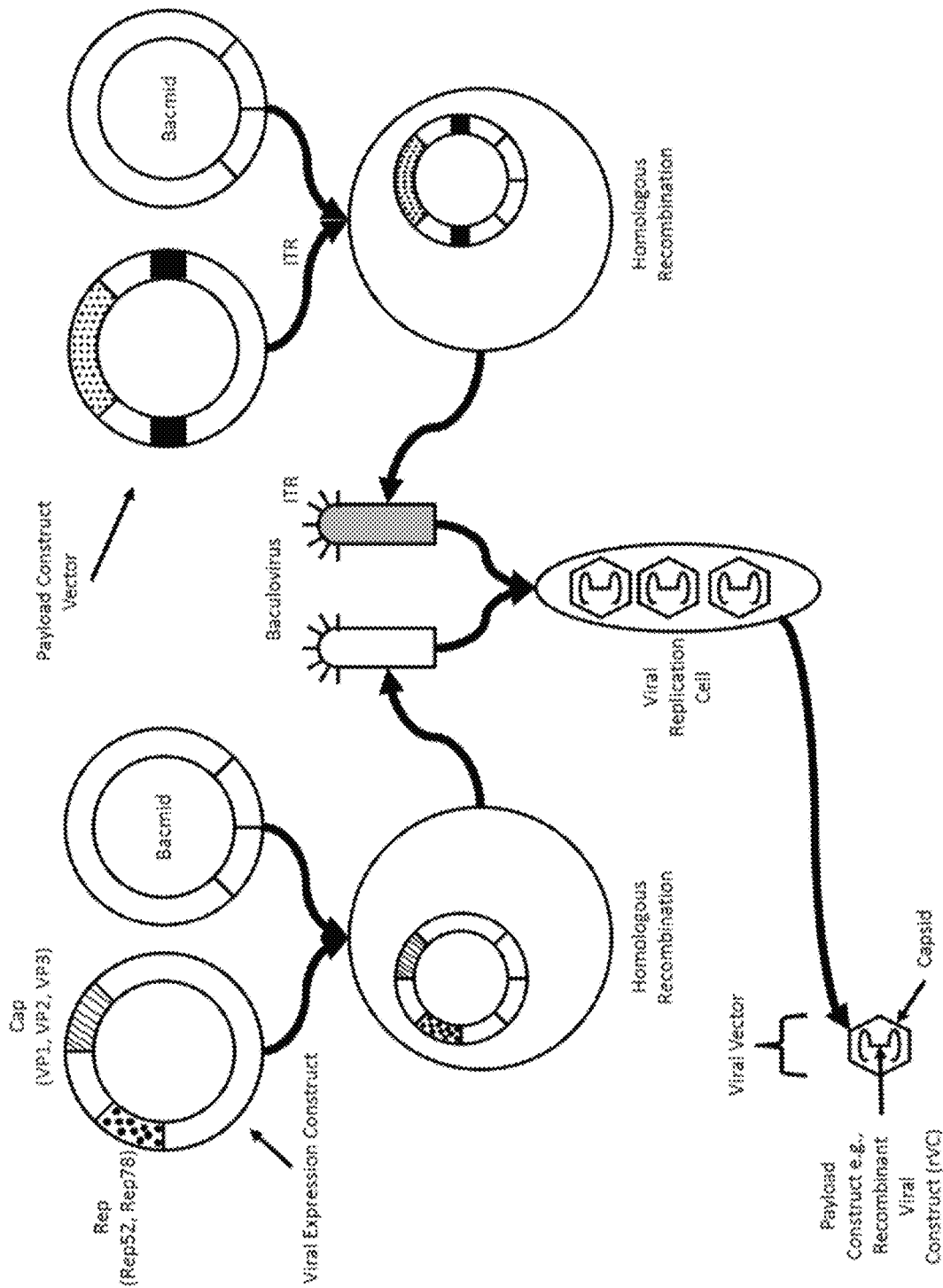
FIG. 2 is a diagram depicting the production of viral vector in a baculoviral system using a viral expression construct and a payload construct vector.

A flow diagram depicting the steps involved in one non-limiting method of large scale viral vector production using a baculoviral system is depicted in FIG. 1. Briefly, the method utilizes seed cultures of viral replication cells that have been transfected with a viral replication construct and a payload construct vector to produce two baculoviruses as depicted in FIG. 2. Seed cultures that are harvested, divided into aliquots and frozen may be used at a later time point to initiate an infection of a naïve population of cells.

Large scale production of viral vector, as depicted in the non-limiting method of FIG. 1 utilizes a bioreactor. The use of a bioreactor allows for the precise measurement and/or control of variables that support the growth and activity of viral replication cells such as mass, temperature, CO2, O2, pH, and/or optical density (OD). In one embodiment, the bioreactor is used for batch production in which the entire culture is harvested at an experimentally determined time point and viral vector is purified. In another embodiment, the bioreactor is used for continuous production in which a portion of the culture is harvested at an experimentally determined time point for purification of viral vector, and the remaining culture in the bioreactor is refreshed with additional growth media components.

Viral vector is extracted from viral replication cells in a process comprising cell lysis, clarification, and purification, as depicted in FIG. 1. Cell lysis comprises any process that disrupts the structure of the viral replication cell, thereby releasing viral vector. In some embodiments cell lysis may comprise thermal shock, chemical, or mechanical lysis methods. Clarification comprises the gross purification of the mixture of lysed cells, media components, and viral vector. In some embodiments, clarification comprises centrifugation and/or filtration, including but not limited to depth end, tangential flow, and/or hollow fiber filtration.

The end result of viral production is a purified viral vector. Accordingly, a viral vector comprises two components: a payload construct, e.g. a recombinant viral construct and optionally a viral capsid.

Expression Constructs

Viral production of the invention disclosed herein involves processes and methods for producing viral vector that contacts a target cell to deliver a payload construct, e.g.

a recombinant viral construct, which comprises a nucleotide encoding a payload molecule.

Figure 3:
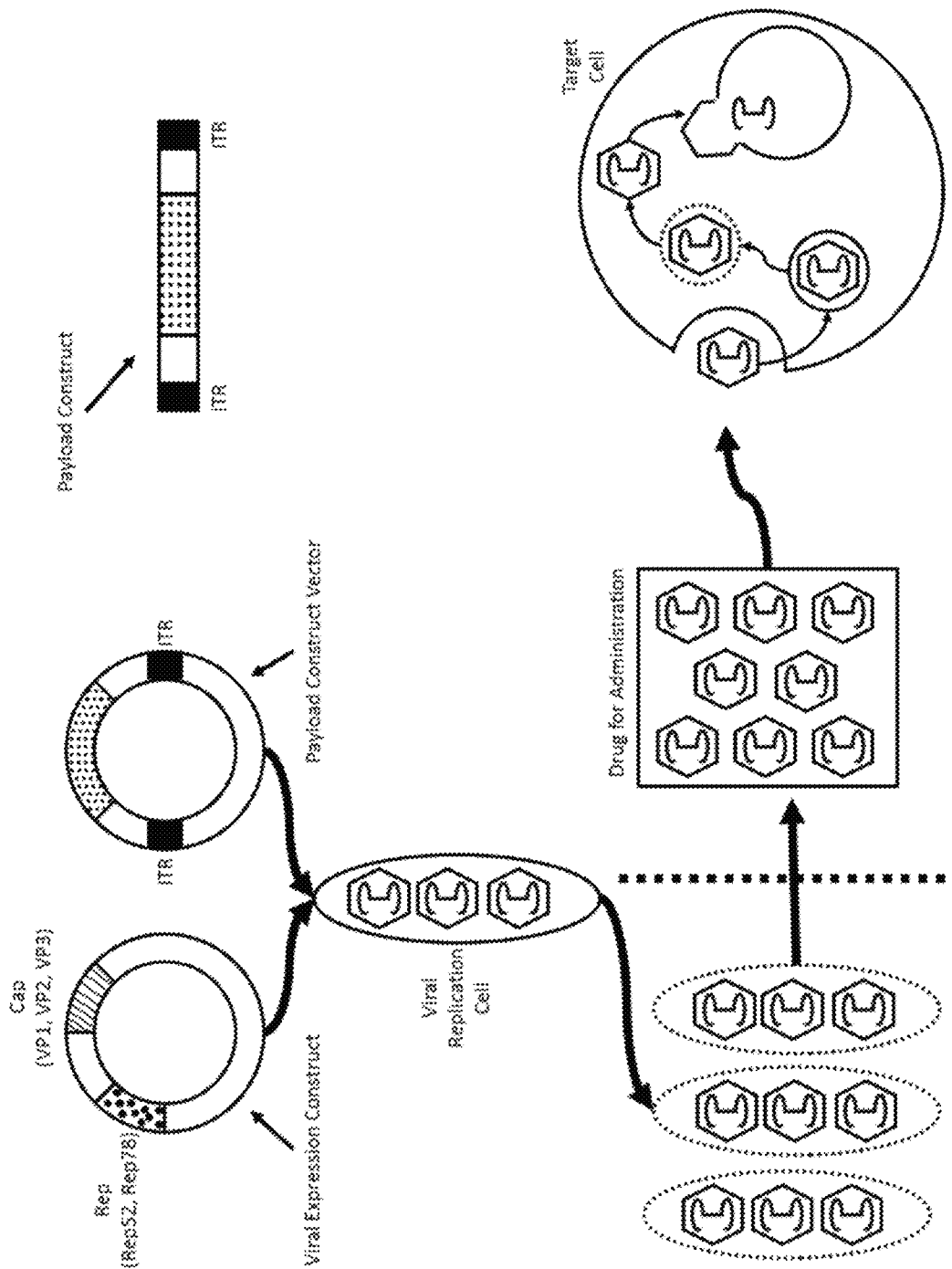
FIG. 3 is a diagram depicting the production of viral vector in a viral replication cell, using a viral expression construct and a payload construct vector, and subsequent delivery of the payload construct (recombinant viral construct) to a target cell.

In one embodiment, the process comprises production of viral vector in a viral replication cell using a viral expression construct and a payload construct vector as depicted in FIG. 3. Briefly, the viral expression construct and the payload construct vector of the invention are co-transfected into a viral replication cell by standard molecular biology techniques known and performed by a person skilled in the art. The viral replication cell provides the cellular machinery necessary for expression of Cap proteins that assemble to form a capsid that encloses the payload construct replicated by the Rep proteins. The resultant viral vector is extracted from the viral replication cells and purified into a preparation for administration. The viral vector contacts a target cell and enters the cell in an endosome. The viral vector releases from the endosome and subsequently contacts the nucleus of the target cell to deliver the payload construct. The payload construct, e.g. recombinant viral construct, is delivered to the nucleus of the target cell wherein the payload molecule encoded by the payload construct may be expressed.

Viral Expression Construct

The viral production system of the invention uses co-infection of a viral replication cell with two constructs. The viral expression construct contains parvoviral genes, rep and cap, under control of one or more promoters including, but not limited to, baculovirus major late promoters, insect virus promoters, non-insect virus promoters, vertebrate virus promoters, nuclear gene promoters, chimeric promoters from one or more species including virus and non-virus elements, and/or synthetic promoters.

The viral production system of the invention is not limited by the viral expression vector used to introduce the parvoviral functions into the virus replication cell. The presence of the viral expression construct in the virus replication cell need not be permanent. The viral expression constructs can be introduced by any means known, for example by chemical treatment of the cells, electroporation, or infection.

Viral expression constructs of the invention may include any compound or formulation, biological or chemical, which facilitates transformation, transfection, or transduction of a cell with a nucleic acid. Exemplary biological viral expression constructs include plasmids, linear nucleic acid molecules, and recombinant viruses including baculovirus. Exemplary chemical vectors include lipid complexes. Viral expression constructs are used to incorporate nucleic acid sequences into virus replication cells in accordance with the present invention. (O'Reilly, David R., Lois K. Miller, and Verne A. Luckow. Baculovirus expression vectors: a laboratory manual. Oxford University Press, 1994.); Maniatis et al., eds. Molecular Cloning. CSH Laboratory, NY, N.Y. (1982); and, Philiport and Scluber, eds. Liposoes as tools in Basic Research and Industry. CRC Press, Ann Arbor, Mich. (1995), the contents of each of which are herein incorporated by reference in its entirety.

The invention disclosed herein is not limited by the number of viral expression constructs employed to produce viral vector. In one embodiment, one, two, three, four, five, six, or more viral expression constructs can be employed to produce viral vector in viral replication cells in accordance with the present invention. In one non-limiting example, six expression vectors may individually encode AAV VP1, AAV VP2, AAV VP3, Rep52, Rep78, and a final transgene vector comprising a polynucleotide and at least one AAV ITR. In another embodiment, expression vectors may be employed to express, for example, Rep52 and Rep40, or Rep78 and Rep 68. Expression vectors may comprise any combination of the at least one AAV ITR and the VP1, VP2, VP3, Rep52/Rep40, and Rep78/Rep68 coding sequences.

In some embodiments the viral expression vector encodes elements to optimize expression in certain cell types. In a further embodiment, the payload construct vector may comprise polh and/or ΔIE-1 insect transcriptional promoters, CMV mammalian transcriptional promoter, and/or p10 insect specific promoters for expression of a desired gene in a mammalian or insect cell.

In one embodiment of the invention, a viral expression construct may be used for the production of a viral vector in insect cells. In some embodiments, modifications may be made to the wild type AAV sequences of the capsid and/or rep genes, for example to improve attributes of the viral particle, such as increased infectivity or specificity, or to enhance production yields.

In one embodiment, the viral expression construct may contain a nucleotide sequence encoding the AAV capsid proteins where the initiation codon of the AAV VP1 capsid protein is a non-ATG, i.e., a suboptimal initiation codon, allowing the expression of a modified ratio of the viral capsid proteins in the insect cell production system, to provide improved infectivity of the host cell. In a non-limiting example, a viral expression construct of the invention may contain a nucleic acid construct comprising a nucleotide sequence encoding AAV VP1, VP2, and VP3 capsid proteins, wherein the initiation codon for translation of the AAV VP1 capsid protein is CTG, TTG, or GTG, as described in U.S. Pat. No. 8,163,543, the contents of which are herein incorporated by reference in its entirety.

In one embodiment, the viral expression construct of the invention may be a baculoviral construct that encodes the parvoviral rep proteins for expression in insect cells. In one embodiment, a single coding sequence is used for the Rep78 and Rep52 proteins, wherein initiation codon for translation of the Rep78 protein is a suboptimal initiation codon, selected from the group consisting of ACG, TTG, CTG and GTG, that effects partial exon skipping upon expression in insect cells, as described in U.S. Pat. No. 8,512,981, the contents of which is herein incorporated by reference in its entirety, for example to promote less abundant expression of Rep78 as compared to Rep52, which may in that it promotes high vector yields.

In one embodiment, the viral expression construct may be a baculoviral construct for the expression in insect cells that contains repeating codons with differential codon biases, for example to achieve improved ratios of Rep proteins, eg. Rep78 and Rep52 thereby improving large scale (commercial) production of viral expression construct and/or payload construct vectors in insect cells, as taught in U.S. Pat. No. 8,697,417, the contents of which is herein incorporated by reference in its entirety.

In another embodiment, improved ratios of rep proteins may be achieved using the method and constructs described in U.S. Pat. No. 8,642,314, the contents of which is herein incorporated by reference in its entirety.

In one embodiment, the viral expression construct may encode mutant parvoviral Rep polypeptides which have one or more improved properties as compared with their corresponding wild type Rep polypeptide. For example, the make enable the preparation of higher virus titers, for large scale production, than a corresponding wild type Rep polypeptide. Alternatively, they may be able to allow the production of better quality viral particles or sustain more stable production of virus. In a non-limiting example, the viral expression construct may encode mutant Rep polypeptides with a mutated nuclear localization sequence or zinc finger domain, as described in Patent Application US 20130023034, the contents of which is herein incorporated by reference in its entirety.

In one embodiment, the viral expression construct may encode the components of a Parvoviral capsid with incorporated Gly-Ala repeat region, which may function as an immune invasion sequence, as described in US Patent Application 20110171262, the contents of which are herein incorporated by reference in its entirety.

In one embodiment, a viral expression construct of the invention may be derived from the AAV4 serotype and allow packaging of the transgene construct in an AAV4 capsid, for example for delivery to an ependymal cell, as described in U.S. Pat. No. 6,468,524, the contents of which are herein incorporated by reference in its entirety.

In one embodiment, a viral expression construct may be derived from the AAV5 serotype and allow packaging of the transgene construct in a AAV5 capsid, for example for delivery to neuronal and/or alveolar cells, as described in U.S. Pat. Nos. 6,984,517, 7,479,554, and, and 6,855,314, the contents of each of which are herein incorporated by reference in their entirety.

In one embodiment of the invention, a viral expression construct may be used for the production of a viral vector in insect cells. In some embodiments, modifications may be made to the wild type AAV sequences of the capsid and/or rep genes, for example to improve attributes of the viral particle, such as increased infectivity or specificity, or to enhance production yields.

In some embodiments, viral expression constructs may be used that are taught in U.S. Pat. Nos. 8,512,981, 8,163,543, 8,697,417, 8,642,314, US Patent Publication Nos. US20130296532, US20110119777, US20110136227, US20110171262, US20130023034, International Patent Application Nos. PCT/NL2008/050613, PCT/NL2009/050076, PCT/NL2009/050352, PCT/NL2011/050170, PCT/NL2012/050619 and U.S. patent application Ser. No. 14/149,953, the contents of each of which are herein incorporated by reference in their entirety.

In some embodiments, the viral expression construct of the invention may be derived from viral expression constructs taught in U.S. Pat. Nos. 6,468,524, 6,984,517, 7,479,554, 6,855,314, 7,271,002, 6,723,551, US Patent Publication No. 20140107186, U.S. patent application Ser. Nos. 09/717,789, 11/936,394, 14/004,379, European Patent Application EP1082413, EP2500434, EP 2683829, EP1572893 and International Patent Application PCT/US99/11958, PCT/US01/09123, PCT/EP2012/054303, and PCT/US2002/035829 the contents of each of which are herein incorporated by reference in its entirety.

In some embodiments, the viral expression construct may include sequences from Simian species. In some embodiments, the viral expression construct may contain sequences, including but not limited to capsid and rep sequences from International Patent Applications PCT/US1997/015694, PCT/US2000/033256, PCT/US2002/019735, PCT/US2002/033645, PCT/US2008/013067, PCT/US2008/013066, PCT/US2008/013065, PCT/US2009/062548, PCT/US2009/001344, PCT/US2010/036332, PCT/US2011/061632, PCT/US2013/041565, U.S. application Ser. Nos. 13/475,535, 13/896,722, 10/739,096, 14/073,979, US Patent Publication Nos. US20010049144, US20120093853, US20090215871, US20040136963, US20080219954, US20040171807, US20120093778, US20080090281, US20050069866, US20100260799, US20100247490, US20140044680, US20100254947, US20110223135, US20130309205, US20120189582, US20130004461, US20130315871, U.S. Pat. Nos. 6,083,716, 7,838,277, 7,344,872, 8,603,459, 8,105,574, 7,247,472, 8,231,880, 8,524,219, 8,470,310, European Patent Application Nos. EP2301582, EP2286841, EP1944043, EP1453543, EP1409748, EP2463362, EP2220217, EP2220241, EP2220242, EP2350269, EP2250255, EP2435559, EP2643465, EP1409748, EP2325298, EP1240345, the contents of each of which is herein incorporated by reference in its entirety.

In some embodiments, viral expression constructs of the invention may include one or more nucleotide sequence from one or more viral construct described in in International Application No. PCT/US2002/025096, PCT/US2002/033629, PCT/US2003/012405, U.S. application Ser. Nos. 10/291,583, 10/420,284, U.S. Pat. No. 7,319,002, US Patent Publication No. US20040191762, US20130045186, US20110263027, US20110151434, US20030138772, US20030207259, European Application No. EP2338900, EP1456419, EP1310571, EP1359217, EP1427835, EP2338900, EP1456419, EP1310571, EP1359217 and U.S. Pat. Nos. 7,235,393 and 8,524,446.

In some embodiments, the viral expression constructs of the invention may comprise sequences or compositions described in International Patent Application No. PCT/US1999/025694, PCT/US1999/010096, PCT/US2001/013000, PCT/US2002/25976, PCT/US2002/033631, PCT/US2002/033630, PCT/US2009/041606, PCT/US2012/025550, U.S. Pat. Nos. 8,637,255, 8,637,255, 7,186,552, 7,105,345, 6,759,237, 7,056,502, 7,198,951, 8,318,480, 7,790,449, 7,282,199, US Patent Publication No. US20130059289, US20040057933, US20040057932, US20100278791, US20080050345, US20080050343, US20080008684, US20060204479, US20040057931, US20040052764, US20030013189, US20090227030, US20080075740, US20080075737, US20030228282, US20130323226, US20050014262, US patent application Ser. Nos. 14/136,331, 09/076,369, 10/738,609, European Application No. EP2573170, EP1127150, EP2341068, EP1845163, EP1127150, EP1078096, EP1285078, EP1463805, EP2010178940, US20140004143, EP2359869, EP1453547, EP2341068, and EP2675902, the contents of each of which are herein incorporated by reference in their entirety.

In some embodiments, viral expression construct of the invention may include one or more nucleotide sequence from one or more of those described in U.S. Pat. Nos. 7,186,552, 7,105,345, 6,759,237, 7,056,502, 7,198,951, 8,318,480, 7,790,449, 7,282,199, US Patent Publication No. US20130059289, US20040057933, US20040057932, US20100278791, US20080050345, US20080050343, US20080008684, US20060204479, US20040057931, US20140004143, US20090227030, US20080075740, US20080075737, US20030228282, US20040052764, US20030013189, US20050014262, US20130323226, US patent application Ser. Nos. 14/136,331, 10/738,609, European Patent Application Nos. EP1127150, EP2341068, EP1845163, EP1127150, EP1078096, EP1285078, EP2573170, EP1463805, EP2675902, EP2359869, EP1453547, EP2341068, the contents of each of which are incorporated herein by reference in their entirety.

In some embodiments, the viral expression constructs of the invention may include constructs of modified AAVs, as described in International Patent Application No. PCT/US1995/014018, PCT/US2000/026449, PCT/US2004/028817, PCT/US2006/013375, PCT/US2007/010056, PCT/US2010/032158, PCT/US2010/050135, PCT/US2011/033596, U.S. patent application Ser. Nos. 12/473,917, 08/331,384, 09/670,277, U.S. Pat. Nos. 5,871,982, 5,856, 152, 6,251,677, 6,387,368, 6,399,385, 7,906,111, European Patent Application No. EP2000103600, European Patent Publication No. EP797678, EP1046711, EP1668143, EP2359866, EP2359865, EP2357010, EP1046711, EP1218035, EP2345731, EP2298926, EP2292780, EP2292779, EP1668143, US20090197338, EP2383346, EP2359867, EP2359866, EP2359865, EP2357010, EP1866422, US20090317417, EP2016174, US Patent Publication Nos. US20110236353, US20070036760, US20100186103, US20120137379, and US20130281516, the contents of each of which are herein incorporated by reference in their entirety.

In some embodiments, the viral expression constructs of the invention may include one or more constructs described in International Application Nos. PCT/US1999/004367, PCT/US2004/010965, PCT/US2005/014556, PCT/US2006/009699, PCT/US2010/032943, PCT/US2011/033628, PCT/US2011/033616, PCT/US2012/034355, U.S. Pat. No. 8,394,386, EP1742668, US Patent Publication Nos. US20080241189, US20120046349, US20130195801, US20140031418, EP2425000, US20130101558, EP1742668, EP2561075, EP2561073, EP2699688, the contents of each of which is herein incorporated by reference in its entirety.

Payload Construct Vector

The viral production system of the invention uses co-infection of a viral replication cell with two constructs. The payload construct vector encodes the payload construct that will be replicated in the viral replication cell, packaged within the viral capsid, and subsequently delivered to the nucleus of the target cell. The payload construct is a viral expression construct and/or payload construct vector that comprises two ITR sequences that flank a polynucleotide sequence under control of one or more promoters including, but not limited to, baculovirus major late promoters, insect virus promoters, non-insect virus promoters, vertebrate virus promoters, nuclear gene promoters, chimeric promoters from one or more species including virus and non-virus elements, and/or synthetic promoters.

In some embodiments the payload construct vector encodes elements to optimize expression in certain cell types. In a further embodiment, the payload construct vector may comprise polh and/or ΔLE-1 insect transcriptional promoters, CMV mammalian transcriptional promoter, and/or p10 insect specific promoters for expression of a desired gene in a mammalian or insect cell.

In one embodiment, the payload construct vector may be used in combination with a viral expression construct, such as a baculoviral construct for expression in insect cells, which comprises a nucleotide sequence encoding at least one parvoviral Rep protein; whose expression is driven by a promoter, and does not comprise a parvoviral Cap protein or a nucleotide sequence encoding a parvoviral Cap protein, as described in US Patent Publication No. 20110119777 the contents of which is herein incorporated by reference in its entirety. This expression system may be useful for large scale production of gene products, including but not limited to the payload and viral rep proteins.

In some embodiments, the payload construct vector of the invention may be derived from viral expression constructs taught in U.S. Pat. Nos. 6,468,524, 6,984,517, 7,479,554, 6,855,314, 7,271,002, 6,723,551, US Patent Publication No. 20140107186, U.S. patent application Ser. Nos. 09/717,789, 11/936,394, 14/004,379, European Patent Application EP1082413, EP2500434, EP 2683829, EP1572893 and International Patent Application PCT/US99/11958, PCT/US01/09123, PCT/EP2012/054303, and PCT/US2002/035829 the contents of each of which are herein incorporated by reference in its entirety.

In some embodiments, the viral expression construct may include sequences from Simian species. In some embodiments, the viral expression construct may contain sequences, including but not limited to capsid and rep sequences from International Patent Publications PCT/US1997/015694, PCT/US2000/033256, PCT/US2002/019735, PCT/US2002/033645, PCT/US2008/013067, PCT/US2008/013066, PCT/US2008/013065, PCT/US2009/062548, PCT/US2009/001344, PCT/US2010/036332, PCT/US2011/061632, PCT/US2013/041565, U.S. application Ser. Nos. 13/475,535, 13/896,722, 10/739,096, 14/073,979, US Patent Publication Nos. US20010049144, US20120093853, US20090215871, US20040136963, US20080219954, US20040171807, US20120093778, US20080090281, US20050069866, US20100260799, US20100247490, US20140044680, US20100254947, US20110223135, US20130309205, US20120189582, US20130004461, US20130315871, U.S. Pat. Nos. 6,083,716, 7,838,277, 7,344,872, 8,603,459, 8,105,574, 7,247,472, 8,231,880, 8,524,219, 8,470,310, European Patent Application Nos. EP2301582, EP2286841, EP1944043, EP1453543, EP1409748, EP2463362, EP2220217, EP2220241, EP2220242, EP2350269, EP2250255, EP2435559, EP2643465, EP1409748, EP2325298, EP1240345, the contents of each of which is herein incorporated by reference in its entirety.

In some embodiments, the payload construct vector, payload construct, payload, and/or viral expression construct and/or payload construct vector may contain sequences from International Patent Application Nos. PCT/US1996/003041, PCT/US1997/015692, PCT/US1998/019470, U.S. patent application Ser. Nos. 08/393,734, 08/729,061, 08/708,188, U.S. Pat. Nos. 7,306,794, 6,887,463, 6,174,527, U.S. Pat. No. 5,652,224 (Assigned to NIH), U.S. Pat. No. 5,866,552, US Patent Publication Nos. US20050112103, US20020182182, US20020131961, US20020037867, US20010006955, European Patent Application Nos. EP811074, EP932418, EP1696036, EP811074, EP932418, EP1696036, the contents of each of which are herein incorporated by reference in its entirety.

In some embodiments, payload construct vectors of the invention may include one or more nucleotide sequence from one or more viral construct described in in International Application No. PCT/US2002/025096, PCT/US2002/033629, PCT/US2003/012405, U.S. application Ser. Nos. 10/291,583, 10/420,284, U.S. Pat. No. 7,319,002, US Patent Publication No. US20040191762, US20130045186, US20110263027, US20110151434, US20030138772, US20030207259, European Application No. EP2338900, EP1456419, EP1310571, EP1359217, EP1427835, EP2338900, EP1456419, EP1310571, EP1359217 and U.S. Pat. Nos. 7,235,393 and 8,524,446.

In some embodiments, the payload construct vectors of the invention may comprise sequences or compositions described in International Patent Application No. PCT/US1999/025694, PCT/US1999/010096, PCT/US2001/013000, PCT/US2002/25976, PCT/US2002/033631, PCT/US2002/033630, PCT/US2009/041606, PCT/US2012/025550, U.S. Pat. Nos. 8,637,255, 8,637,255, 7,186,552, 7,105,345, 6,759,237, 7,056,502, 7,198,951, 8,318,480, 7,790,449, 7,282,199, US Patent Publication No. US20130059289, US20040057933, US20040057932, US20100278791, US20080050345, US20080050343, US20080008684, US20060204479, US20040057931, US20040052764, US20030013189, US20090227030, US20080075740, US20080075737, US20030228282, US20130323226, US20050014262, U.S. patent application Ser. Nos. 14/136,331, 09/076,369, 10/738,609, European Application No. EP2573170, EP1127150, EP2341068, EP1845163, EP1127150, EP1078096, EP1285078, EP1463805, EP2010178940, US20140004143, EP2359869, EP1453547, EP2341068, and EP2675902, the contents of each of which are herein incorporated by reference in their entirety.

In some embodiments, the payload construct vector may include sequences from Simian species. In some embodiments, the viral expression construct may contain sequences, including but not limited to capsid and rep sequences from International Patent Applications PCT/US1997/015694, PCT/US2000/033256, PCT/US2002/019735, PCT/US2002/033645, PCT/US2008/013067, PCT/US2008/013066, PCT/US2008/013065, PCT/US2009/062548, PCT/US2009/001344, PCT/US2010/036332, PCT/US2011/061632, PCT/US2013/041565, U.S. application Ser. Nos. 13/475,535, 13/896,722, 10/739,096, 14/073,979, US Patent Publication Nos. US20010049144, US20120093853, US20090215871, US20040136963, US20080219954, US20040171807, US20120093778, US20080090281, US20050069866, US20100260799, US20100247490, US20140044680, US20100254947, US20110223135, US20130309205, US20120189582, US20130004461, US20130315871, U.S. Pat. Nos. 6,083,716, 7,838,277, 7,344,872, 8,603,459, 8,105,574, 7,247,472, 8,231,880, 8,524,219, 8,470,310, European Patent Application Nos. EP2301582, EP2286841, EP1944043, EP1453543, EP1409748, EP2463362, EP2220217, EP2220241, EP2220242, EP2350269, EP2250255, EP2435559, EP2643465, EP1409748, EP2325298, EP1240345, the contents of each of which is herein incorporated by reference in its entirety.

In some embodiments, the payload construct vector of the invention may include one or more nucleotide sequence from one or more of those described in U.S. Pat. Nos. 7,186,552, 7,105,345, 6,759,237, 7,056,502, 7,198,951, 8,318,480, 7,790,449, 7,282,199, US Patent Publication No. US20130059289, US20040057933, US20040057932, US20100278791, US20080050345, US20080050343, US20080008684, US20060204479, US20040057931, US20140004143, US20090227030, US20080075740, US20080075737, US20030228282, US20040052764, US20030013189, US20050014262, US20130323226, U.S. patent application Ser. Nos. 14/136,331, 10/738,609, European Patent Application Nos. EP1127150, EP2341068, EP1845163, EP1127150, EP1078096, EP1285078, EP2573170, EP1463805, EP2675902, EP2359869, EP1453547, EP2341068, the contents of each of which are incorporated herein by reference in their entirety.

In some embodiments, the payload construct vectors of the invention may include one or more inducible and regulatable constructs, as described in International Patent Application Nos. PCT/US2011/030213, PCT/US2012/057803, PCT/US2002/000961, US Patent Publication Nos. US20130023033, US20120058102 and European Patent Application No. EP2553106, the contents of each of which are incorporated herein by reference in their entirety.

In some embodiments, the payload construct vector of the invention may include constructs of modified AAVs, as described in International Patent Application No. PCT/US1995/014018, PCT/US2000/026449, PCT/US2004/028817, PCT/US2006/013375, PCT/US2007/010056, PCT/US2010/032158, PCT/US2011/033596, U.S. patent application Ser. Nos. 12/473,917, 08/331,384, 09/670,277, U.S. Pat. No 5,871,982, 5,856,152, 6,251,677, 6,387,368, 6,399,385, 7,906,111, European Patent Application No. EP2000103600, European Patent Publication No. EP797678, EP1046711, EP1668143, EP2359866, EP2359865, EP2357010, EP1046711, EP1218035, EP2345731, EP2298926, EP2292780, EP2292779, EP1668143, US20090197338, EP2383346, EP2359867, EP2359866, EP2359865, EP2357010, EP1866422, US20090317417, EP2016174, US Patent Publication Nos. US20110236353, US20070036760, US20100186103, US20120137379, and US20130281516, the contents of each of which are herein incorporated by reference in their entirety.

In some embodiments, the payload construct vector of the invention may include one or more constructs described in International Application Nos. PCT/US1999/004367, PCT/US2004/010965, PCT/US2005/014556, PCT/US2006/009699, PCT/US2010/032943, PCT/US2011/033628, PCT/US2011/033616, PCT/US2012/034355, U.S. Pat. No. 8,394,386, EP1742668, US Patent Publication Nos. US20080241189, US20120046349, US20130195801, US20140031418, EP2425000, US20130101558, EP1742668, EP2561075, EP2561073, EP2699688, the contents of each of which is herein incorporated by reference in its entirety.

The payload construct vector may have flanking ITRs from different serotypes. In one embodiment, transgene construct of the invention may contain AAV4 ITRs, as described in U.S. Pat. No. 6,468,524 (inventors Chiorini and Kotin), the contents of which is herein incorporated by reference in its entirety, which can for example be used to deliver a the nucleic acid of interest to the ependymal cell.

In one embodiment, the payload construct vector comprises AAV5 ITRs, as described in U.S. Pat. Nos. 6,984,517 and 7,479,554. In one embodiment, the construct may comprise AAV5 ITRs, as described in U.S. Pat. Nos. 6,984,517, 7,479,554, and 6,855,314, the contents of each of which are herein incorporated by reference in their entirety.

In one embodiment, the payload construct vector of the invention may encode closed-ended, linear duplex molecules that can be amplified from the vector. In a non-limiting example, these closed-ended, linear duplex molecules may be CELiD DNA, as described in Lina Li, Emilios K. Dimitriadis, Yu Yang, Juan Li, Zhenhua Yuan, Chunping Qiao, Cyriaque Beley, Richard H. Smith, Luis Garcia, Robert M. Kotin: Production and Characterization of Novel Recombinant Adeno-Associated Virus Replicative-Form Genomes: A Eukaryotic Source of DNA for Gene Transfer PLOS ONE 8 (8): e69879, the contents of which is herein incorporated by reference in its entirety.

CELiD

CELiD DNA comprises at least one transgene and at least one promoter to drive the expression of the transgene and contains inverted terminal repeats (ITRs) from the adeno-associated virus type 2 (AAV) on each end. Without wishing to be bound by theory, the covalent closure at each end of the linear construct protects against degradation, and confers stability to the CELiD DNA, which otherwise as a linear DNA duplex molecule may be susceptible to exonuclease activity.

CELiD DNA may be amplified to high copy number in insect cells, such as *Spodoptera frugiperda* (Sf9) cells, in the presence of a viral expression construct containing proteins Rep78 and Rep52, as described in Lina Li, Emilios K. Dimitriadis, Yu Yang, Juan Li, Zhenhua Yuan, Chunping Qiao, Cyriaque Beley, Richard H. Smith, Luis Garcia, Robert M. Kotin: Production and Characterization of Novel Recombinant Adeno-Associated Virus Replicative-Form Genomes: A Eukaryotic Source of DNA for Gene Transfer PLOS ONE 8 (8): e69879, the contents of which is herein incorporated by reference in its entirety. In one embodiment, a second baculoviral contruct encoding the AAV replication proteins may be used in combination with the baculoviral construct encoding the CELiD. In another embodiment, the CeLID DNA may be amplified using a 519 cell line that bears a stably integrated rAAV vector genome.

Other Expression Constructs

In some embodiments, the viral expression construct may include sequences from Simian species. In some embodiments, the viral expression construct may contain sequences, including but not limited to capsid and rep sequences from International Patent Applications PCT/US1997/015694, PCT/US2000/033256, PCT/US2002/019735, PCT/US2002/033645, PCT/US2008/013067, PCT/US2008/013066, PCT/US2008/013065, PCT/US2009/062548, PCT/US2009/001344, PCT/US2010/036332, PCT/US2011/061632, PCT/US2013/041565, U.S. application Ser. No. 13/475,535, U.S. Ser. Nos. 13/896,722, 10/739,096, 14/073,979, US Patent Publication Nos. US20010049144, US20120093853, US20090215871, US20040136963, US20080219954, US20040171807, US20120093778, US20080090281, US20050069866, US20100260799, US20100247490, US20140044680, US20100254947, US20110223135, US20130309205, US20120189582, US20130004461, US20130315871, U.S. Pat. Nos. 6,083,716, 7,838,277, 7,344,872, 8,603,459, 8,105,574, 7,247,472, 8,231,880, 8,524,219, 8,470,310, European Patent Application Nos. EP2301582, EP2286841, EP1944043, EP1453543, EP1409748, EP2463362, EP2220217, EP2220241, EP2220242, EP2350269, EP2250255, EP2435559, EP2643465, EP1409748, EP2325298, EP1240345, the contents of each of which is herein incorporated by reference in its entirety.

In some embodiments, viral expression construct and/or payload construct vectors of the invention may include one or more nucleotide sequence from one or more of those described in in International Application No. PCT/US2002/025096, PCT/US2002/033629, PCT/US2003/012405, U.S. application Ser. Nos. 10/291,583, 10/420,284, 7,319,002, US Patent Publication No. US20040191762, US20130045186, US20110263027, US20110151434, US20030138772, US20030207259, European Application No. EP2338900, EP1456419, EP1310571, EP1359217, EP1427835, EP2338900, EP1456419, EP1310571, EP1359217 and U.S. Pat. Nos. 7,235,393 and 8,524,446.

In some embodiments, the constructs of the invention may comprise sequences or compositions described in International Patent Application No. PCT/US1999/025694, PCT/US1999/010096, PCT/US2001/013000, PCT/US2002/25976, PCT/US2002/033631, PCT/US2002/033630, PCT/US2009/041606, PCT/US2012/025550, U.S. Pat. Nos. 8,637,255, 8,637,255, 7,186,552, 7,105,345, 6,759,237, 7,056,502, 7,198,951, 8,318,480, 7,790,449, 7,282,199, US Patent Publication No. US20130059289, US20040057933, US20040057932, US20100278791, US20080050345, US20080050343, US20080008684, US20060204479, US20040057931, US20040052764, US20030013189, US20090227030, US20080075740, US20080075737, US20030228282, US20130323226, US20050014262, U.S. patent application Ser. Nos. 14/136,331, 09/076,369, 10/738,609, European Application No. EP2573170, EP1127150, EP2341068, EP1845163, EP1127150, EP1078096, EP1285078, EP1463805, EP2010178940, US20140004143, EP2359869, EP1453547, EP2341068, and EP2675902, the contents of each of which are herein incorporated by reference in their entirety.

In some embodiments, the viral expression construct and/or payload construct vector of the invention may include one or more nucleotide sequence from one or more of those described in U.S. Pat. Nos. 7,186,552, 7,105,345, 6,759,237, 7,056,502, 7,198,951, 8,318,480, 7,790,449, 7,282,199, US Patent Publication No. US20130059289, US20040057933, US20040057932, US20100278791, US20080050345, US20080050343, US20080008684, US20060204479, US20040057931, US20140004143, US20090227030, US20080075740, US20080075737, US20030228282, US20040052764, US20030013189, US20050014262, US20130323226, U.S. patent application Ser. Nos. 14/136,331, 10/738,609, European Patent Application Nos. EP1127150, EP2341068, EP1845163, EP1127150, EP1078096, EP1285078, EP2573170, EP1463805, EP2675902, EP2359869, EP1453547, EP2341068, the contents of each of which are incorporated herein by reference in their entirety.

In some embodiments, the viral expression construct and/or payload construct vector of the invention may include one or more inducible and regulatable constructs, as described in International Patent Application Nos. PCT/US2011/030213, PCT/US2012/057803, PCT/US2002/000961, US Patent Publication Nos. US20130023033, US20120058102 and European Patent Application No. EP2553106, the contents of each of which are incorporated herein by reference in their entirety.

In some embodiments, the viral expression construct and/or payload construct vector of the invention may include constructs of modified AAVs, as described in International Patent Application No. PCT/US1995/014018, PCT/US2000/026449, PCT/US2004/028817, PCT/US2006/013375, PCT/US2007/010056, PCT/US2010/032158, PCT/US2010/050135, PCT/US2011/033596, U.S. patent application Ser. Nos. 12/473,917, 08/331,384, 09/670,277, 5,871,982, 5,856,152, 6,251,677, 6,387,368, 6,399,385, 7,906,111, European Patent Application No. EP2000103600, European Patent Publication No. EP797678, EP1046711, EP1668143, EP2359866, EP2359865, EP2357010, EP1046711, EP1218035, EP2345731, EP2298926, EP2292780, EP2292779, EP1668143, US20090197338, EP2383346, EP2359867, EP2359865, EP2359865, EP2357010, EP1866422, US20090317417, EP2016174, US Patent Publication Nos. US20110236353, US20070036760, US20100186103, US20120137379, and US20130281516, the contents of each of which are herein incorporated by reference in their entirety.

In some embodiments, the viral expression construct and/or payload construct vector of the invention may include one or more constructs described in International Application Nos. PCT/US1999/004367, PCT/US2004/010965, PCT/US2005/014556, PCT/US2006/009699, PCT/US2010/032943, PCT/US2011/033628, PCT/US2011/033616, PCT/US2012/034355, U.S. Pat. No. 8,394,386, EP1742668, US Patent Publication Nos. US20080241189, US20120046349, US20130195801, US20140031418, EP2425000, US20130101558, EP1742668, EP2561075, EP2561073, EP2699688, the contents of each of which is herein incorporated by reference in its entirety.

Control Mechanisms

Structural VP proteins, VP1, VP2, and VP3, and non-structural proteins, Rep 52 and Rep78, of the viral expression construct are encoded in a single open reading frame regulated by utilization of both alternative splice acceptor and non-canonical translational initiation codons. Both Rep 78 and Rep 52 are translated from a single transcript: Rep 78 translation initiates at a non-AUG codon and Rep 52 translation initiates at the first AUG in the transcript. VP1, VP2 and VP3 are translated from a single transcript wherein both in-frame and out-of-frame ATG triplets preventing translation initiation at a position between the VP1 and VP2 start codons are eliminated.

The VP and Rep coding nucleotide sequences are operably linked to at least one expression control sequence for expression in a viral producing cell. Herein, "coding nucleotide sequences" refer to that portion of a nucleotide sequence that is translated into a protein product. "Operably linked" means that the expression control sequence is positioned relative to the coding sequence such that it can promote the expression of the encoded gene product.

"Expression control sequence" refers to a nucleic acid sequence that regulates the expression of a nucleotide sequence to which it is operably linked. An expression control sequence is "operably linked" to a nucleotide sequence when the expression control sequence controls and regulates the transcription and/or the translation of the nucleotide sequence. Thus, an expression control sequence can include promoters, enhancers, internal ribosome entry sites (IRES), transcription terminators, a start codon in front of a protein-encoding gene, splicing signal for introns, and stop codons. The term "expression control sequence" is intended to include, at a minimum, a sequence whose presence are designed to influence expression, and can also include additional advantageous components. For example, leader sequences and fusion partner sequences are expression control sequences. The term can also include the design of the nucleic acid sequence such that undesirable, potential initiation codons in and out of frame, are removed from the sequence. It can also include the design of the nucleic acid sequence such that undesirable potential splice sites are removed. It includes sequences or polyadenylation sequences (pA) which direct the addition of a polyA tail, i.e., a string of adenine residues at the 3'-end of an mRNA, sequences referred to as polyA sequences. It also can be designed to enhance mRNA stability. Expression control sequences which affect the transcription and translation stability, e.g., promoters, as well as sequences which effect the translation, e.g., Kozak sequences, are known in insect cells. Expression control sequences can be of such nature as to modulate the nucleotide sequence to which it is operably linked such that lower expression levels or higher expression levels are achieved.

More than one expression control sequence can be operably linked to a given nucleotide sequence. For example, a promoter sequence, a translation initiation sequence, and a stop codon can be operably linked to a nucleotide sequence.

The translational start site of eukaryotic mRNA is controlled in part by a nucleotide sequence referred to as a Kozak sequence as described in Kozak, M *Cell*. 1986 Jan. 31; 44(2):283-92 and Kozak, M. J Cell Biol. 1989 February; 108(2):229-41 the contents of each of which are herein incorporated by reference in their entirety. Both naturally occurring and synthetic translational start sites of the Kozak form can be used in the production of polypeptides by molecular genetic techniques, Kozak, M. *Mamm Genome*. 1996 August; 7(8):563-74 the contents of which are herein incorporated by reference in their entirety. Splice sites are sequences on an mRNA which facilitate the removal of parts of the mRNA sequences after the transcription (formation) of the mRNA. Typically, the splicing occurs in the nucleus, prior to mRNA transport into a cell's cytoplasm.

The method of the invention is not limited by the use of specific expression control sequences. However, when a certain stoichiometry of VP products are achieved (close to 1:1:10 for VP1, VP2, and VP3, respectively) and also when the levels of Rep52 or Rep40 (also referred to as the p19 Reps) are significantly higher than Rep78 or Rep68 (also referred to as the p5 Reps), the best yields of AAV in insect cell may be obtained. In one embodiment, the p5/p19 ratio is below 0.6 more preferably below 0.4, more preferably yet, below 0.3, but always at least 0.03. These ratios can be measured at the level of the protein or can be implicated from the relative levels of specific mRNAs.

In one embodiment of the invention, Rep52 is transcribed from the baculoviral derived polyhedron promoter, (polh). Rep78 is transcribed from a weaker promoter, for example a deletion mutant of the IE-1 promoter, the ΔIE-1 promoter, has about 20% of the transcriptional activity of that IE-1 promoter. A promoter substantially homologous to the ΔIE-1 promoter may be used. In respect to promoters, a homology of at least 50%, 60%, 70%, preferably 80%, more preferably 90% or more, is considered to be a substantially homologous promoter.

Viral Vectors

In some embodiments, the viral vector may include sequences from Simian species. In some embodiments, the viral expression construct may contain sequences, including but not limited to capsid and rep sequences from International Patent Applications PCT/US1997/015694, PCT/US2000/033256, PCT/US2002/019735, PCT/US2002/033645, PCT/US2008/013067, PCT/US2008/013066, PCT/US2008/013065, PCT/US2009/062548, PCT/US2009/001344, PCT/US2010/036332, PCT/US2011/061632, PCT/US2013/041565, U.S. application Ser. Nos. 13/475,535, 13/896,722, 10/739,096, 14/073,979, US Patent Publication Nos. US20010049144, US20120093853, US20090215871, US20040136963, US20080219954, US20040171807, US20120093778, US20080090281, US20050069866, US20100260799, US20100247490, US20140044680, US20100254947, US20110223135, US20130309205, US20120189582, US20130004461, US20130315871, U.S. Pat. Nos. 6,083,716, 7,838,277, 7,344,872, 8,603,459, 8,105,574, 7,247,472, 8,231,880, 8,524,219, 8,470,310, European Patent Application Nos. EP2301582, EP2286841, EP1944043, EP1453543, EP1409748, EP2463362, EP2220217, EP2220241, EP2220242, EP2350269, EP2250255, EP2435559, EP2643465, EP1409748, EP2325298, EP1240345, the contents of each of which is herein incorporated by reference in its entirety.

In some embodiments, viral vectors of the invention may include one or more nucleotide sequence from one or more of those described in in International Application No. PCT/US2002/025096, PCT/US2002/033629, PCT/US2003/012405, U.S. application Ser. Nos. 10/291,583, 10/420,284, U.S. Pat. No. 7,319,002, US Patent Publication No. US20040191762, US20130045186, US20110263027, US20110151434, US20030138772, US20030207259, European Application No. EP2338900, EP1456419, EP1310571, EP1359217, EP1427835, EP2338900, EP1456419, EP1310571, EP1359217 and U.S. Pat. Nos. 7,235,393 and 8,524,446.

In some embodiments, the viral vectors of the invention may comprise sequences or compositions described in International Patent Application No. PCT/US1999/025694, PCT/US1999/010096, PCT/US2001/013000, PCT/US2002/25976, PCT/US2002/033631, PCT/US2002/033630, PCT/US2009/041606, PCT/US2012/025550, U.S. Pat. Nos. 8,637,255, 8,637,255, 7,186,552, 7,105,345, 6,759,237, 7,056,502, 7,198,951, 8,318,480, 7,790,449, 7,282,199, US Patent Publication No. US20130059289, US20040057933, US20040057932, US20100278791, US20080050345, US20080050343, US20080008684, US20060204479, US20040057931, US20040052764, US20030013189, US20090227030, US20080075740, US20080075737, US20030228282, US20130323226, US20050014262, U.S. patent application Ser. Nos. 14/136,331, 09/076,369, 10/738,609, European Application No. EP2573170, EP1127150, EP2341068, EP1845163, EP1127150, EP1078096, EP1285078, EP1463805, EP2010178940, US20140004143, EP2359869, EP1453547, EP2341068, and EP2675902, the contents of each of which are herein incorporated by reference in their entirety.

In some embodiments, the viral vector of the invention may include one or more nucleotide sequence from one or more of those described in U.S. Pat. Nos. 7,186,552, 7,105, 345, 6,759,237, 7,056,502, 7,198,951, 8,318,480, 7,790,449, 7,282,199, US Patent Publication No. US20130059289, US20040057933, US20040057932, US20100278791, US20080050345, US20080050343, US20080008684, US20060204479, US20040057931, US20140004143, US20090227030, US20080075740, US20080075737, US20030228282, US20040052764, US20030013189, US20050014262, US20130323226, U.S. patent application Ser. Nos. 14/136,331, 10/738,609, European Patent Application Nos. EP1127150, EP2341068, EP1845163, EP1127150, EP1078096, EP1285078, EP2573170, EP1463805, EP2675902, EP2359869, EP1453547, EP2341068, the contents of each of which are incorporated herein by reference in their entirety.

In some embodiments, the viral vectors of the invention may include one or more inducible and regulatable constructs, as described in International Patent Application Nos. PCT/US2011/030213, PCT/US2012/057803, PCT/US2002/000961, US Patent Publication Nos. US20130023033, US20120058102 and European Patent Application No. EP2553106, the contents of each of which are incorporated herein by reference in their entirety.

In some embodiments, the viral vectors of the invention may include constructs of modified AAVs, as described in International Patent Application No. PCT/US1995/014018, PCT/US2000/026449, PCT/US2004/028817, PCT/US2006/013375, PCT/US2007/010056, PCT/US2010/032158, PCT/US2010/050135, PCT/US2011/033596, U.S. patent application Ser. Nos. 12/473,917, 08/331,384, 09/670,277, 5,871, 982, 5,856,152, 6,251,677, 6,387,368, 6,399,385, 7,906,111, European Patent Application No. EP2000103600, European Patent Publication No. EP797678, EP1046711, EP1668143, EP2359866, EP2359865, EP2357010, EP1046711, EP1218035, EP2345731, EP2298926, EP2292780, EP2292779, EP1668143, US20090197338, EP2383346, EP2359867, EP2359866, EP2359865, EP2357010, EP1866422, US20090317417, EP2016174, US Patent Publication Nos. US20110236353, US20070036760, US20100186103, US20120137379, and US20130281516, the contents of each of which are herein incorporated by reference in their entirety.

In some embodiments, the viral vector of the invention may include one or more constructs described in International Application Nos. PCT/US1999/004367, PCT/US2004/010965, PCT/US2005/014556, PCT/US2006/009699, PCT/US2010/032943, PCT/US2011/033628, PCT/US2011/033616, PCT/US2012/034355, U.S. Pat. No. 8,394,386, EP1742668, US Patent Publication Nos. US20080241189, US20120046349, US20130195801, US20140031418, EP2425000, US20130101558, EP1742668, EP2561075, EP2561073, EP2699688, the contents of each of which is herein incorporated by reference in its entirety.

In some embodiments, The present invention provides methods of producing viral vectors by (a) contacting a viral replication cell with one or more viral expression constructs encoding at least one chimeric capsid protein, and one or more payload construct vectors, wherein said payload construct vector comprises a payload construct encoding a payload molecule selected from the group consisting of a transgene, a polynucleotide encoding protein, and a modulatory nucleic acid; (b) culturing said viral replication cell under conditions such that at least one viral vector is produced, and (c) isolating said at least one viral vector.

In these methods a viral expression construct may encode at least one structural protein and at least one non-structural protein. The structural protein may comprise any of the native or wild type capsid proteins VP1, VP2 and/or VP3 or a chimeric protein.

The non-structural protein may comprise any of the native or wild type Rep78, Rep68, Rep52 and/or Rep40 proteins or a chimeric protein.

In some embodiments, contacting occurs via transient transfection, viral transduction and/or electroporation.

In some embodiments, the viral replication cell is selected from the group consisting of a mammalian cell and an insect cell. In some embodiments, the insect cell comprises a *Spodoptera frugiperda* (Sf9) cell.

The payload construct vector of the invention may comprise at least one inverted terminal repeat (ITR) and may comprise mammalian DNA.

In some embodiments, the payload construct vector comprises closed-ended, linear duplex (CELiD) DNA.

Also provided are viral vectors produced according to the methods described herein.

The viral vectors of the present invention may be formulated as a pharmaceutical composition with one or more acceptable excipients.

In one embodiment, a viral vector may be produced by a method described herein.

In one embodiment, the viral vector may be produced by contacting a viral replication cell (e.g., an insect cell or a mammalian cell) with at least one viral expression constructs encoding at least one chimeric capsid protein and at least one payload construct vectors. The viral replication cell may be contacted by transient transfection, viral transduction and/or electroporation. The payload construct vector may comprise a payload construct encoding a payload molecule such as, but not limited to, a transgene, a polynucleotide encoding protein, and a modulatory nucleic acid. The viral replication cell can be cultured under conditions such that at least one viral vector is produced, isolated (e.g., using temperature-induced lysis, mechanical lysis and/or chemical lysis) and/or purified (e.g., using filtration, chromatography and/or immunoaffinity purification). As a non-limiting example, the payload construct vector may comprise mammalian DNA.

In one embodiment, the viral vector is produced in an insect cell (e.g., *Spodoptera frugiperda* (Sf9) cell) using the method described herein. As a non-limiting example, the insect cell is contacted using viral transduction which may include baculoviral transduction.

In another embodiment, the viral vector is produced in a mammalian cell using the method described herein. As a non-limiting example, the mammalian cell is contacted using transient transfection.

In one embodiment, the viral expression construct may encode at least one structural protein and at least one non-structural protein. As a non-limiting example, the structural protein comprises VP1, VP2 and/or VP3. As another non-limiting example, the non-structural protein comprises Rep78, Rep68, Rep52 and/or Rep40.

In one embodiment, the viral expression construct may comprise a plasmid, payload construct vector with at least one inverted terminal repeat (ITR) and/or a payload construct vector with closed-ended, linear duplex (CELiD) DNA.

In one embodiment, the viral vector production method described herein produces greater than $10^1$, greater than $10^2$, greater than $10^3$, greater than $10^4$ or greater than $10^5$ viral vectors in a viral replication cell.

Mammalian-production System

Viral production of the invention disclosed herein describes processes and methods for producing viral vector that contacts a target cell to deliver a payload construct, e.g. a recombinant viral construct, which comprises a nucleotide encoding a payload molecule.

In one embodiment, the viral vector of the invention may be produced in a viral replication cell that comprises a mammalian cell.

Viral replication cells commonly used for production of recombinant AAV viral vector include, but is not limited to 293 cells, COS cells, HeLa cells, KB cells, and other mammalian cell lines as described in U.S. Pat. Nos. 6,156,303, 5,387,484, 5,741,683, 5,691,176, and 5,688,676; U.S. patent application 2002/0081721, and International Patent Publication Nos. WO 00/47757, WO 00/24916, and WO 96/17947, the contents of each of which are herein incorporated by reference in their entireties.

In one embodiment, viral vector produced in mammalian-cells wherein all three VP proteins are expressed at a stoichiometry approaching 1:1:10 (VP1:VP2:VP3). The regulatory mechanisms that allow this controlled level of expression include the production of two mRNAs, one for VP1, and the other for VP2 and VP3, produced by differential splicing.

Baculovirus-production System

Viral production of the invention disclosed herein describes processes and methods for producing viral vector that contacts a target cell to deliver a payload construct, e.g. a recombinant viral construct, which comprises a nucleotide encoding a payload molecule.

In one embodiment, the process comprises production of viral vector in a baculoviral system using a viral expression construct and a payload construct vector as depicted in FIG. 2. Briefly, the viral expression construct and the payload construct vector of the invention are each incorporated by homologous recombination into a bacmid, also known as a baculovirus plasmid, by standard molecular biology techniques known and performed by a person skilled in the art. Two baculoviruses may be produced, one that comprises the viral expression construct, and another that comprises the payload construct vector. The two baculoviruses depicted in FIG. 2 may be used to infect a viral replication cell for production of viral vector.

Baculovirus expression vectors for producing viral vector in insect cells, including but not limited to *Spodoptera frugiperda* (Sf9) cells, provide high titers of viral vector product. Recombinant baculovirus encoding the viral expression construct and payload construct initiates a productive infection of viral vector replicating cells. Infectious baculovirus particles released from the primary infection secondarily infect additional cells in the culture, exponentially infecting the entire cell culture population in a number of infection cycles that is a function of the initial multiplicity of infection, see Urabe, M. et al. J Virol. 2006 February; 80(4):1874-85, the contents of which are herein incorporated by reference in their entirety.

Production of viral vector with baculovirus in an insect cell system may address known baculovirus genetic and physical instability. In one embodiment, the production system of the invention addresses baculovirus instability over multiple passages by utilizing a titerless infected-cells preservation and scale-up system. Small scale seed cultures of viral producing cells are transfected with viral expression constructs encoding the structural, non-structural, components of the viral vector. Baculovirus-infected viral producing cells are harvested into aliquots that may be cryopreserved in liquid nitrogen; the aliquots retain viability and infectivity for infection of large scale viral producing cell culture Wasilko D J et al. Protein Expr Purif. 2009 June; 65(2):122-32, the contents of which are herein incorporated by reference in their entirety.

A genetically stable baculovirus may be used to produce source of the one or more of the components for producing viral vector in invertebrate cells. In one embodiment, defective baculovirus expression vectors may be maintained episomally in insect cells. In such an embodiment the bacmid vector is engineered with replication control elements, including but not limited to promoters, enhancers, and/or cell-cycle regulated replication elements.

In one embodiment, baculoviruses may be engineered with a (non-) selectable marker for recombination into the chitinase/cathepsin locus. The chia/v-cath locus is non-essential for propagating baculovirus in tissue culture, and the V-cath (EC 3.4.22.50) is a cysteine endoprotease that is most active on Arg-Arg dipeptide containing substrates. The Arg-Arg dipeptide is present in densovirus and parvovirus capsid structural proteins but infrequently occurs in dependovirus VP1.

In one embodiment, stable viral producing cells permissive for baculovirus infection are engineered with at least one stable integrated copy of any of the elements necessary for AAV replication and vector production including, but not limited to, the entire AAV genome, Rep and Cap genes, Rep genes, Cap genes, each Rep protein as a separate transcription cassette, each VP protein as a separate transcription cassette, the AAP (assembly activation protein), or at least one of the baculovirus helper genes with native or non-native promoters.

Insect Cells

Viral production of the invention disclosed herein describes processes and methods for producing viral vector that contacts a target cell to deliver a payload construct, e.g. a recombinant viral construct, which comprises a nucleotide encoding a payload molecule.

In one embodiment, the viral vector of the invention may be produced in a viral replication cell that comprises an insect cell.

Growing conditions for insect cells in culture, and production of heterologous products in insect cells in culture are well-known in the art, see U.S. Pat. No. 6,204,059, the contents of which are herein incorporated by reference in their entirety.

Any insect cell which allows for replication of parvovirus and which can be maintained in culture can be used in accordance with the present invention. Cell lines may be used from *Spodoptera frupperda*, including, but not limited to the Sf9 or Sf21 cell lines, *drosophila* cell lines, or mosquito cell lines, such as, *Aedes albopictus* derived cell lines. Use of insect cells for expression of heterologous proteins is well documented, as are methods of introducing nucleic acids, such as vectors, e.g., insect-cell compatible vectors, into such cells and methods of maintaining such cells in culture. See, for example, METHODS IN MOLECULAR BIOLOGY, ed. Richard, Humana Press, N.J. (1995); O'Reilly et al., BACULOVIRUS EXPRESSION VECTORS, A LABORATORY MANUAL, Oxford Univ. Press (1994); Samulski et al., *J. Vir.*63:3822-8 (1989); Kajigaya et al., *Proc. Nat'l. Acad. Sci. USA* 88: 4646-50 (1991); Ruffing et al., *J. Vir.* 66:6922-30 (1992); Kimbauer et al., *Vir.*219:37-44 (1996); Zhao et al., *Vir.*272:382-93 (2000); and Samulski et al., U.S. Pat. No. 6,204,059, the contents of each of which are herein incorporated by reference in their entirety.

Viral Production

In one embodiment, an expression cell is a mammalian cell, such as HEK 293 cell line, for example, as described in U.S. Pat. No. 6,428,988, the contents of which are herein incorporated by reference in its entirety.

In one embodiment, the packaging cell line 293-10-3 (ATCC Accession No. PTA-2361) may be used to produce the viral vector, as described in U.S. Pat. No. 6,281,010, the contents of which are herein incorporated by reference in its entirety.

In some embodiments expression hosts include, but are not limited to, bacterial species within the genera *Escherichia, Bacillus, Pseudomonas, Salmonella*.

In other embodiments, cell expression systems may comprise established mammalian cell lines, such as COS-7, C127, 3T3, CHO, HeLa, and BHK.

In some embodiments, insect host cell systems, in combination with baculoviral systems (e.g., as described by Luckow et al., Bio/Technology 6: 47 (1988) may be used. In one embodiments, an expression system for preparing chimeric peptides is *Trichoplusia ni*, Tn 5B1-4 insect cells/baculoviral system, which can be used for high levels of proteins, as described in U.S. Pat. No. 6,660,521, the contents of which is herein incorporated by reference in its entirety.

In one embodiment, of the invention a cell line, such as a HeLA cell line, for trans-complementing E1 deleted adenoviral vectors, which encoding adenovirus E1a and adenovirus E1b under the control of a phosphoglycerate kinase (PGK) promoter can be used for viral vector production as described in U.S. Pat. No. 6,365,394, the contents of which is incorporated herein by reference in its entirety.

In one embodiment, a host cell which host cell which comprises AAV rep and cap genes stably integrated within the cell's chromosomes, may be used for viral vector production. In a non-limiting example, the host cell which has stably integrated in its chromosome at least two copies of an AAV rep gene and AAV cap gene may be used to produce the viral vector according to the methods and constructs described in U.S. Pat. No. 7,238,526, the contents of which is incorporated herein by reference in its entirety.

In one embodiment, the viral vector can be produced in a host cell stably transformed with a molecule comprising the nucleic acid sequences which permit the regulated expression of a rare restriction enzyme in the host cell, as described in US20030092161 and EP1183380, the contents of which is herein incorporated by reference in its entirety.

In some embodiments, production methods and cell lines to produce the viral vector may include, but are not limited to those taught in PCT/US1996/010245, PCT/US1997/015716, PCT/US1997/015691, PCT/US1998/019479, PCT/US1998/019463, PCT/US2000/000415, PCT/US2000/040872, PCT/US2004/016614, PCT/US2007/010055, PCT/US1999/005870, PCT/US2000/004755, U.S. patent application Ser. Nos. 08/549,489, 08/462,014, 09/659,203, 10/246,447, 10/465,302, U.S. Pat. Nos. 6,281,010, 6,270,996, 6,261,551, 5,756,283 (Assigned to NIH), U.S. Pat. Nos. 6,428,988, 6,274,354, 6,943,019, 6,482,634, (Assigned to NIH: U.S. Pat. Nos. 7,238,526, 6,475,769), U.S. Pat. No. 6,365,394 (Assigned to NIH), U.S. Pat. Nos. 7,491,508, 7,291,498, 7,022,519, 6,485,966, 6,953,690, 6,258,595, EP2018421, EP1064393, EP1163354, EP835321, EP931158, EP950111, EP1015619, EP1183380, EP2018421, EP1226264, EP1636370, EP1163354, EP1064393, US20030032613, US20020102714, US20030073232, US20030040101 (Assigned to NIH), US20060003451, US20020090717, US20030092161, US20070231303, US20060211115, US20090275107, US2007004042, US20030119191, US20020019050, the contents of each of which are incorporated herein by reference in their entirety.

Large-scale Production

In some embodiments, viral vector production may be modified to increase the scale of production. Large scale viral production methods according to the present invention may include any of those taught in U.S. Pat. Nos. 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498 and 7,491,508 or International Publication Nos. WO1996039530, WO1998010088, WO1999014354, WO1999015685, WO1999047691, WO2000055342, WO2000075353 and WO2001023597, the contents of each of which are herein incorporated by reference by reference in their entirety. Methods of increasing viral vector production scale typically comprise increasing the number of viral replication cells. In some embodiments, viral replication cells comprise adherent cells. To increase the scale of viral vector production by adherent viral replication cells, larger cell culture surfaces are required. In some cases, large-scale production methods comprise the use of roller bottles to increase cell culture surfaces. Other cell culture substrates with increased surface areas are known in the art. Examples of additional adherent cell culture products with increased surface areas include, but are not limited to CELLSTACK®, CELLCUBE® (Corning Corp., Corning, N.Y.) and NUNC™ CELL FACTORY™ (Thermo Scientific, Waltham, Mass.) In some cases, large-scale adherent cell surfaces may comprise from about 1,000 $cm^2$ to about 100,000 $cm^2$. In some cases, large-scale adherent cell cultures may comprise from about $10^7$ to about $10^9$ cells, from about $10^8$ to about $10^{10}$ cells, from about $10^9$ to about $10^{12}$ cells or at least $10^{12}$ cells. In some cases, large-scale adherent cultures may produce from about $10^9$ to about $10^{12}$, from about $10^{10}$ to about $10^{13}$, from about $10^{11}$ to about $10^{14}$, from about $10^{12}$ to about $10^{15}$ or at least $10^{15}$ viral vector particles.

In some embodiments, large-scale viral production methods of the present invention may comprise the use of suspension cell cultures. Suspension cell culture allows for significantly increased numbers of cells. Typically, the number of adherent cells that can be grown on about 10-50 $cm^2$ of surface area can be grown in about 1 $cm^3$ volume in suspension.

Transfection of replication cells in large-scale culture formats may be carried out according to any methods known in the art. For large-scale adherent cell cultures, transfection methods may include, but are not limited to the use of inorganic compounds (e.g. calcium phosphate,) organic compounds (e.g. polyethyleneimine (PEI)) or the use of non-chemical methods (e.g. electroporation.) With cells grown in suspension, transfection methods may include, but are not limited to the use of calcium phosphate and the use of PEI. In some cases, transfection of large scale suspension cultures may be carried out according to the section entitled "Transfection Procedure" described in Feng, L. et al., 2008. Biotechnol Appl Biochem. 50:121-32, the contents of which are herein incorporated by reference in their entirety. According to such embodiments, PEI-DNA complexes may be formed for introduction of plasmids to be transfected. In some cases, cells being transfected with PEI-DNA complexes may be 'shocked' prior to transfection. This comprises lowering cell culture temperatures to 4° C. for a period of about 1 hour. In some cases, cell cultures may be shocked for a period of from about 10 minutes to about 5 hours. In some cases, cell cultures may be shocked at a temperature of from about 0° C. to about 20° C.

In some cases, transfections may include one or more vectors for expression of an RNA effector molecule to reduce expression of nucleic acids from one or more payload construct. Such methods may enhance the production of viral vectors by reducing cellular resources wasted on expressing payload constructs. In some cases, such methods may be carried out according to those taught in US Publication No. US2014/0099666, the contents of which are herein incorporated by reference in their entirety.

Bioreactors

In some embodiments, cell culture bioreactors may be used for large scale viral vector production. In some cases, bioreactors comprise stirred tank reactors. Such reactors generally comprise a vessel, typically cylindrical in shape, with a stirrer (e.g. impeller.) In some embodiments, such bioreactor vessels may be placed within a water jacket to control vessel temperature and/or to minimize effects from ambient temperature changes. Bioreactor vessel volume may range in size from about 500 ml to about 2 L, from about 1 L to about 5 L, from about 2.5 L to about 20 L, from about 10 L to about 50 L, from about 25 L to about 100 L, from about 75 L to about 500 L, from about 250 L to about 2,000 L, from about 1,000 L to about 10,000 L, from about 5,000 L to about 50,000 L or at least 50,000 L. Vessel bottoms may be rounded or flat. In some cases, animal cell cultures may be maintained in bioreactors with rounded vessel bottoms.

In some cases, bioreactor vessels may be warmed through the use of a thermocirculator. Thermocirculators pump heated water around water jackets. In some cases, heated water may be pumped through pipes (e.g. coiled pipes) that are present within bioreactor vessels. In some cases, warm air may be circulated around bioreactors, including, but not limited to air space directly above culture medium. Additionally, pH and $CO_2$ levels may be maintained to optimize cell viability.

In some cases, bioreactors may comprise hollow-fiber reactors. Hollow-fiber bioreactors may support the culture of both anchorage dependent and anchorage independent cells. Further bioreactors may include, but are not limited to packed-bed or fixed-bed bioreactors. Such bioreactors may comprise vessels with glass beads for adherent cell attachment. Further packed-bed reactors may comprise ceramic beads.

In some cases, viral vectors are produced through the use of a disposable bioreactor. In some embodiments, such bioreactors may include WAVE™ disposable bioreactors.

In some embodiments, viral vector production in animal cell bioreactor cultures may be carried out according to the methods taught in U.S. Pat. Nos. 5,064,764, 6,194,191, 6,566,118, 8,137,948 or US Patent Application No. US2011/0229971, the contents of each of which are herein incorporated by reference in their entirety.

Cell Lysis

Cells of the invention, including, but not limited to viral production cells, may be subjected to cell lysis according to any methods known in the art. Cell lysis may be carried out to obtain one or more agents (e.g. viral vectors) present within any cells of the invention. In some embodiments, cell lysis may be carried out according to any of the methods listed in U.S. Pat. Nos. 7,326,555, 7,579,181, 7,048,920, 6,410,300, 6,436,394, 7,732,129, 7,510,875, 7,445,930, 6,726,907, 6,194,191, 7,125,706, 6,995,006, 6,676,935, 7,968,333, 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498 and 7,491,508 or International Publication Nos. WO1996039530, WO1998010088, WO1999014354, WO1999015685, WO1999047691, WO2000055342, WO2000075353 and WO2001023597, the contents of each of which are herein incorporated by reference in their entirety. Cell lysis methods may be chemical or mechanical. Chemical cell lysis typically comprises contacting one or more cells with one or more lysis agent. Mechanical lysis typically comprises subjecting one or more cells to one or more lysis condition and/or one or more lysis force.

In some embodiments, chemical lysis may be used to lyse cells. As used herein, the term "lysis agent" refers to any agent that may aid in the disruption of a cell. In some cases, lysis agents are introduced in solutions, termed lysis solutions or lysis buffers. As used herein, the term "lysis solution" refers to a solution (typically aqueous) comprising one or more lysis agent. In addition to lysis agents, lysis solutions may include one or more buffering agents, solubilizing agents, surfactants, preservatives, cryoprotectants, enzymes, enzyme inhibitors and/or chelators. Lysis buffers are lysis solutions comprising one or more buffering agent. Additional components of lysis solutions may include one or more solubilizing agent. As used herein, the term "solubilizing agent" refers to a compound that enhances the solubility of one or more components of a solution and/or the solubility of one or more entities to which solutions are applied. In some cases, solubilizing agents enhance protein solubility. In some cases, solubilizing agents are selected based on their ability to enhance protein solubility while maintaining protein conformation and/or activity.

Exemplary lysis agents may include any of those described in U.S. Pat. Nos. 8,685,734, 7,901,921, 7,732,129, 7,223,585, 7,125,706, 8,236,495, 8,110,351, 7,419,956, 7,300,797, 6,699,706 and 6,143,567, the contents of each of which are herein incorporated by reference in their entirety. In some cases, lysis agents may be selected from lysis salts, amphoteric agents, cationic agents, ionic detergents and non-ionic detergents. Lysis salts may include, but are not limited to sodium chloride (NaCl) and potassium chloride (KCl). Further lysis salts may include any of those described in U.S. Pat. Nos. 8,614,101, 7,326,555, 7,579,181, 7,048, 920, 6,410,300, 6,436,394, 7,732,129, 7,510,875, 7,445,930, 6,726,907, 6,194,191, 7,125,706, 6,995,006, 6,676,935 and 7,968,333, the contents of each of which are herein incorporated by reference in their entirety. Concentrations of salts may be increased or decreased to obtain an effective concentration for rupture of cell membranes. Amphoteric agents, as referred to herein, are compounds capable of reacting as an acid or a base. Amphoteric agents may include, but are not limited to lysophosphatidylcholine, 3-((3-Cholamidopropyl)dimethylammonium)-1-propanesulfonate (CHAPS), ZWITTERGENT® and the like. Cationic agents may include, but are not limited to cetyltrimethylammonium bromide (C(16)TAB) and Benzalkonium chloride. Lysis agents comprising detergents may include ionic detergents or non-ionic detergents. Detergents may function to break apart or dissolve cell structures including, but not limited to cell membranes, cell walls, lipids, carbohydrates, lipoproteins and glycoproteins. Exemplary ionic detergents include any of those taught in U.S. Pat. Nos. 7,625,570 and 6,593,123 or US Publication No. US2014/0087361, the contents of each of which are herein incorporated by reference in their entirety. Some ionic detergents may include, but are not limited to sodium dodecyl sulfate (SDS), cholate and deoxycholate. In some cases, ionic detergents may be included in lysis solutions as a solubilizing agent. Non-ionic detergents may include, but are not limited to octylglucoside, digitonin, lubrol, C12E8, TWEEN®-20, TWEEN®-80, Triton X-100 and Noniodet P-40. Non-ionic detergents are typically weaker lysis agents, but may be included as solubilizing agents for solubilizing cellular and/or viral proteins. Further lysis agents may include enzymes and urea. In some cases, one or more lysis agents may be combined in a lysis solution in order to enhance one or more of cell lysis and protein solubility. In some cases, enzyme inhibitors may be included in lysis solutions in order to prevent proteolysis that may be triggered by cell membrane disruption.

In some embodiments, mechanical cell lysis is carried out. Mechanical cell lysis methods may include the use of one or more lysis condition and/or one or more lysis force. As used herein, the term "lysis condition" refers to a state or circumstance that promotes cellular disruption. Lysis conditions may comprise certain temperatures, pressures, osmotic purity, salinity and the like. In some cases, lysis conditions comprise increased or decreased temperatures. According to some embodiments, lysis conditions comprise changes in temperature to promote cellular disruption. Cell lysis carried out according to such embodiments may include freeze-thaw lysis. As used herein, the term "freeze-thaw lysis" refers to cellular lysis in which a cell solution is subjected to one or more freeze-thaw cycle. According to freeze-thaw lysis methods, cells in solution are frozen to induce a mechanical disruption of cellular membranes caused by the formation and expansion of ice crystals. Cell solutions used according freeze-thaw lysis methods, may further comprise one or more lysis agents, solubilizing agents, buffering agents, cryoprotectants, surfactants, preservatives, enzymes, enzyme inhibitors and/or chelators. Once cell solutions subjected to freezing are thawed, such components may enhance the recovery of desired cellular products. In some cases, one or more cyroprotectants are included in cell solutions undergoing freeze-thaw lysis. As used herein, the term "cryoprotectant" refers to an agent used to protect one or more substance from damage due to freezing. Cryoprotectants of the invention may include any of those taught in US Publication No. US2013/0323302 or U.S. Pat. Nos. 6,503,888, 6,180,613, 7,888,096, 7,091,030, the contents of each of which are herein incorporated by reference in their entirety. In some cases, cryoprotectants may include, but are not limited to dimethyl sulfoxide, 1,2-propanediol, 2,3-butanediol, formamide, glycerol, ethylene glycol, 1,3-propanediol and n-dimethyl formamide, polyvinylpyrrolidone, hydroxyethyl starch, agarose, dextrans, inositol, glucose, hydroxyethylstarch, lactose, sorbitol, methyl glucose, sucrose and urea. In some embodiments, freeze-thaw lysis may be carried out according to any of the methods described in U.S. Pat. No. 7,704,721, the contents of which are herein incorporated by reference in their entirety.

As used herein, the term "lysis force" refers to a physical activity used to disrupt a cell. Lysis forces may include, but are not limited to mechanical forces, sonic forces, gravitational forces, optical forces, electrical forces and the like. Cell lysis carried out by mechanical force is referred to herein as "mechanical lysis." Mechanical forces that may be used according to mechanical lysis may include high shear fluid forces. According to such methods of mechanical lysis, a microfluidizer may be used. Microfluidizers typically comprise an inlet reservoir where cell solutions may be applied. Cell solutions may then be pumped into an interaction chamber via a pump (e.g. high-pressure pump) at high speed and/or pressure to produce shear fluid forces. Resulting lysates may then be collected in one or more output reservoir. Pump speed and/or pressure may be adjusted to modulate cell lysis and enhance recovery of products (e.g. viral vectors). Other mechanical lysis methods may include physical disruption of cells by scraping.

Cell lysis methods may be selected based on the cell culture format of cells to be lysed. For example, with adherent cell cultures, some chemical and mechanical lysis methods may be used. Such mechanical lysis methods may include freeze-thaw lysis or scraping. In another example, chemical lysis of adherent cell cultures may be carried out through incubation with lysis solutions comprising surfactant, such as Triton-X-100. In some cases, cell lysates generated from adherent cell cultures may be treated with one more nuclease to lower the viscosity of the lysates caused by liberated DNA.

In one embodiment, a method for harvesting AAV without lysis may be used for efficient and scalable AAV production. In a non-limiting example, Viral vectors may be produced by culturing an AAV lacking a heparin binding site, thereby allowing the AAV to pass into the supernatant, in a cell culture, collecting supernatant from the culture; and isolating the AAV from the supernatant, as described in US Patent Application 20090275107, the contents of which is incorporated herein by reference in its entirety.

Clarification

Cell lysates comprising viral vectors may be subjected to clarification. Clarification refers to initial steps taken in purification of viral vectors from cell lysates. Clarification serves to prepare lysates for further purification by removing larger, insoluble debris. Clarification steps may include, but are not limited to centrifugation and filtration. During clarification, centrifugation may be carried out at low speeds to remove larger debris, only. Similarly, filtration may be carried out using filters with larger pore sizes so that only larger debris is removed. In some cases, tangential flow filtration may be used during clarification. Objectives of viral clarification include high throughput processing of cell lysates and to optimize ultimate viral recovery. Advantages of including a clarification step include scalability for processing of larger volumes of lysate. In some embodiments, clarification may be carried out according to any of the methods presented in U.S. Pat. Nos. 8,524,446, 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498, 7,491,508, US Publication Nos. US2013/0045186, US2011/0263027, US2011/0151434, US2003/0138772, and International Publication Nos. WO2002012455, WO1996039530, WO1998010088, WO1999014354, WO1999015685, WO1999047691, WO2000055342, WO2000075353 and WO2001023597, the contents of each of which are herein incorporated by reference in their entirety.

Methods of cell lysate clarification by filtration are well understood in the art and may be carried out according to a variety of available methods including, but not limited to passive filtration and flow filtration. Filters used may comprise a variety of materials and pore sizes. For example, cell lysate filters may comprise pore sizes of from about 1 µM to about 5 µM, from about 0.5 µM to about 2 µM, from about 0.1 µM to about 1 µM, from about 0.05 µM to about 0.05 µM and from about 0.001 µM to about 0.1 µM. Exemplary pore sizes for cell lysate filters may include, but are not limited to, 2.0, 1.9, 1.8, 1.7, 1.6, 1.5, 1.4, 1.3, 1.2, 1.1, 1, 0.9, 0.8, 0.7, 0.6, 0.5, 0.4, 0.3, 0.2, 0.1, 0.95, 0.9, 0.85, 0.8, 0.75, 0.7, 0.65, 0.6, 0.55, 0.5, 0.45, 0.4, 0.35, 0.3, 0.25, 0.2, 0.15, 0.1, 0.05, 0.22, 0.21, 0.20, 0.19, 0.18, 0.17, 0.16, 0.15, 0.14, 0.13, 0.12, 0.11, 0.1, 0.09, 0.08, 0.07, 0.06, 0.05, 0.04, 0.03, 0.02, 0.01, 0.02, 0.019, 0.018, 0.017, 0.016, 0.015, 0.014, 0.013, 0.012, 0.011, 0.01, 0.009, 0.008, 0.007, 0.006, 0.005, 0.004, 0.003, 0.002, 0.001 and 0.001 µM. In one embodiment, clarification may comprise filtration through a filter with 2.0 µM pore size to remove large debris, followed by passage through a filter with 0.45 µM pore size to remove intact cells.

Filter materials may be composed of a variety of materials. Such materials may include, but are not limited to polymeric materials and metal materials (e.g. sintered metal and pored aluminum.) Exemplary materials may include, but are not limited to nylon, cellulose materials (e.g. cellulose acetate), polyvinylidene fluoride (PVDF), polyethersulfone, polyamide, polysulfone, polypropylene and polyethylene terephthalate. In some cases, filters useful for clarification of cell lysates may include, but are not limited to ULTIPLEAT PROFILE™ filters (Pall Corporation, Port Washington, N.Y.), SUPOR™ membrane filters (Pall Corporation, Port Washington, N.Y.).

In some cases, flow filtration may be carried out to increase filtration speed and/or effectiveness. In some cases, flow filtration may comprise vacuum filtration. According to such methods, a vacuum is created on the side of the filter opposite that of cell lysate to be filtered. In some cases, cell lysates may be passed through filters by centrifugal forces. In some cases, a pump is used to force cell lysate through clarification filters. Flow rate of cell lysate through one or more filters may be modulated by adjusting one of channel size and/or fluid pressure.

According to some embodiments, cell lysates may be clarified by centrifugation. Centrifugation may be used to pellet insoluble particles in the lysate. During clarification, centrifugation strength (expressed in terms of gravitational units (g), which represents multiples of standard gravitational force) may be lower than in subsequent purification steps. In some cases, centrifugation may be carried out on cell lysates at from about 200 g to about 800 g, from about 500 g to about 1500 g, from about 1000 g to about 5000 g, from about 1200 g to about 10000 g or from about 8000 g to about 15000 g. In some embodiments, cell lysate centrifugation is carried out at 8000 g for 15 minutes. In some cases, density gradient centrifugation may be carried out in order to partition particulates in the cell lysate by sedimentation rate. Gradients used according to methods of the present invention may include, but are not limited to cesium chloride gradients and iodixanol step gradients.

Purification—Chromatography

In some cases, viral vectors may be purified from clarified cell lysates by one or more methods of chromatography. Chromatography refers to any number of methods known in the art for separating out one or more elements from a mixture. Such methods may include, but are not limited to ion exchange chromatography (e.g. cation exchange chromatography and anion exchange chromatography), immunoaffinity chromatography and size-exclusion chromatography. In some embodiments, methods of viral chromatography may include any of those taught in U.S. Pat. Nos. 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498 and 7,491,508 or International Publication Nos. WO1996039530, WO1998010088, WO1999014354, WO1999015685, WO1999047691, WO2000055342, WO2000075353 and WO2001023597, the contents of each of which are herein incorporated by reference by reference in their entirety.

In some embodiments, ion exchange chromatography may be used to isolate viral vectors. Ion exchange chromatography is used to bind viral vectors based on charge-charge interactions between capsid proteins and charged sites present on a stationary phase, typically a column through which viral preparations (e.g. clarified lysates) are passed. After application of viral preparations, bound viral vectors may then be eluted by applying an elution solution to disrupt the charge-charge interactions. Elution solutions may be optimized by adjusting salt concentration and/or pH to enhance recovery of bound viral vectors. Depending on the charge of viral capsids being isolated, cation or anion exchange chromatography methods may be selected. Methods of ion exchange chromatography may include, but are not limited to any of those taught in U.S. Pat. Nos. 7,419,817, 6,143,548, 7,094,604, 6,593,123, 7,015,026 and 8,137,948, the contents of each of which are herein incorporated by reference in their entirety.

In some embodiments, immunoaffinity chromatography may be used. Immunoaffinity chromatography is a form of chromatography that utilizes one or more immune compounds (e.g. antibodies or antibody-related structures) to retain viral vectors. Immune compounds may bind specifically to one or more structures on viral vector surfaces, including, but not limited to one or more viral coat protein. In some cases, immune compounds may be specific for a particular viral variant. In some cases, immune compounds may bind to multiple viral variants. In some embodiments, immune compounds may include recombinant single-chain antibodies. Such recombinant single chain antibodies may include those described in Smith, R. H. et al., 2009. Mol Ther. 17(11):1888-96, the contents of which are herein incorporated by reference in their entirety. Such immune compounds are capable of binding to several AAV capsid variants, including, but not limited to AAV1, AAV2, AAV6 and AAV8.

In some embodiments, size-exclusion chromatography (SEC) may be used. SEC may comprise the use of a gel to separate particles according to size. In viral vector purification, SEC filtration is sometimes referred to as "polishing." In some cases, SEC may be carried out to generate a final product that is near-homogenous. Such final products may in some cases be used in pre-clinical studies and/or clinical studies (Kotin, R. M. 2011. Human Molecular Genetics. 20(1):R2-R6, the contents of which are herein incorporated by reference in their entirety). In some cases, SEC may be carried out according to any of the methods taught in U.S. Pat. Nos. 6,143,548, 7,015,026, 8,476,418, 6,410,300, 8,476,418, 7,419,817, 7,094,604, 6,593,123, and 8,137,948, the contents of each of which are herein incorporated by reference in their entirety.

In one embodiment, the compositions comprising at least one viral vector may be isolated or purified using the methods described in U.S. Pat. No. 6,146,874, the contents of which are herein incorporated by reference in its entirety.

In one embodiment, the compositions comprising at least one viral vector may be isolated or purified using the methods described in U.S. Pat. No. 6,660,514, the contents of which are herein incorporated by reference in its entirety.

In one embodiment, the compositions comprising at least one viral vector may be isolated or purified using the methods described in U.S. Pat. No. 8,283,151, the contents of which are herein incorporated by reference in its entirety.

In one embodiment, the compositions comprising at least one viral vector may be isolated or purified using the methods described in U.S. Pat. No. 8,524,446, the contents of which are herein incorporated by reference in its entirety.

V. Pharmaceutical Compositions and Delivery

Although the descriptions of pharmaceutical compositions, e.g., those viral vectors comprising a payload to be delivered, provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

In some embodiments, compositions are administered to humans, human patients or subjects. For the purposes of the present disclosure, the phrase "active ingredient" generally refers either to the viral vector carrying the payload or to the payload molecule delivered by the viral vector as described herein.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired dose unit.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered.

Formulation

The viral vectors of the invention can be formulated using one or more excipients to: (1) increase stability; (2) increase cell transfection or transduction; (3) permit the sustained or delayed release; (4) alter the biodistribution (e.g., target the viral vector to specific tissues or cell types); (5) increase the translation of encoded protein in vivo; and/or (6) alter the release profile of encoded protein in vivo.

Formulations of the present invention can include, without limitation, saline, lipidoids, liposomes, lipid nanoparticles, polymers, lipoplexes, core-shell nanoparticles, peptides, proteins, cells transfected with viral vectors (e.g., for transplantation into a subject), nanoparticle mimics and combinations thereof. Further, the viral vectors of the present invention may be formulated using self-assembled nucleic acid nanoparticles.

Formulations of the pharmaceutical compositions described herein may be prepared by any method known or hereafter developed in the art of pharmacology. In general, such preparatory methods include the step of associating the active ingredient with an excipient and/or one or more other accessory ingredients.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the formulations described herein may contain at least one payload molecule. As a non-limiting example, the formulations may contain 1, 2, 3, 4 or 5 payload molecules. In one embodiment the formulation may contain a payload construct encoding proteins selected from categories such as, but not limited to, human proteins, veterinary proteins, bacterial proteins, biological proteins, antibodies, immunogenic proteins, therapeutic peptides and proteins, secreted proteins, plasma membrane proteins, cytoplasmic and cytoskeletal proteins, intracellular membrane bound proteins, nuclear proteins, proteins associated with human disease and/or proteins associated with non-human diseases. In one embodiment, the formulation contains at least three payload construct encoding proteins.

The formulations of the invention can include one or more excipients, each in an amount that together increases the stability of the viral vector, increases cell transfection or transduction by the viral vector, increases the expression of viral vector encoded protein, and/or alters the release profile of viral vector encoded proteins. In some embodiments, a pharmaceutically acceptable excipient may be at least 95%, at least 96%, at least 97%, at least 98%, at least 99%, or 100% pure. In some embodiments, an excipient is approved for use for humans and for veterinary use. In some embodiments, an excipient may be approved by United States Food and Drug Administration. In some embodiments, an excipient may be of pharmaceutical grade. In some embodiments, an excipient may meet the standards of the United States Pharmacopoeia (USP), the European Pharmacopoeia (EP), the British Pharmacopoeia, and/or the International Pharmacopoeia.

Excipients, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro, Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate) (VEEGUM®, sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and VEEGUM® [magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [TWEEN® 20], polyoxyethylene sorbitan [TWEEN® 60], polyoxyethylene sorbitan monooleate [TWEEN® 80], sorbitan monopalmitate [SPAN® 40], sorbitan monostearate [SPAN® 60], sorbitan tristearate [SPAN® 65], glyceryl monooleate, sorbitan monooleate [SPAN® 80]), polyoxyethylene esters (e.g. polyoxyethylene monostearate [MYRJ® 45], polyoxyethylene hydrogenated castor oil, polyethoxylated castor oil, polyoxymethylene stearate, and SOLUTOL®), sucrose fatty acid esters, polyethylene glycol fatty acid esters (e.g. CREMOPHOR®), polyoxyethylene ethers, (e.g. polyoxyethylene lauryl ether [BRIJ®30]), poly (vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC® F. 68, POLOXAMER®188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol); amino acids (e.g., glycine); natural and synthetic gums (e.g. acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate)(VEEGUM®, and larch arabogalactan); alginates; polyethylene oxide; polyethylene glycol; inorganic calcium salts; silicic acid; polymethacrylates; waxes; water; alcohol; etc.; and combinations thereof.

Exemplary preservatives may include, but are not limited to, antioxidants, chelating agents, antimicrobial preservatives, antifungal preservatives, alcohol preservatives, acidic preservatives, and/or other preservatives. Oxidation is a potential degradation pathway for mRNA, especially for liquid mRNA formulations. In order to prevent oxidation, antioxidants can be added to the formulation. Exemplary antioxidants include, but are not limited to, alpha tocopherol, ascorbic acid, acorbyl palmitate, benzyl alcohol, butylated hydroxyanisole, EDTA, m-cresol, methionine, butylated hydroxytoluene, monothioglycerol, potassium metabisulfite, propionic acid, propyl gallate, sodium ascorbate, sodium bisulfite, sodium metabisulfite, thioglycerol and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL®115, GERMABEN®II, NEOLONE™, KATHON™, and/or EUXYL®.

Exemplary buffering agents may also include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, *litsea cubeba*, macadamia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Exemplary additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

Cryoprotectants

In some embodiments, viral vector formulations may comprise cyroprotectants. As used herein, there term "cryoprotectant" refers to one or more agent that when combined with a given substance, helps to reduce or eliminate damage to that substance that occurs upon freezing. In some embodiments, cryoprotectants are combined with viral vectors in order to stabilize them during freezing. Frozen storage between −20° C. and −80° C. may be advantageous for long term (e.g. 36 months) stability of viral vectors. In some embodiments, cryoprotectants are included in viral vector formulations to stabilize them through freeze/thaw cycles and under frozen storage conditions. Cryoprotectants of the present invention may include, but are not limited to sucrose, trehalose, lactose, glycerol, dextrose, raffinose and/or mannitol. Trehalose is listed by the Food and Drug Administration as being generally regarded as safe (GRAS) and is commonly used in commercial pharmaceutical formulations.

Bulking Agents

In some embodiments, viral vector formulations may comprise bulking agents. As used herein, ther term "bulking agent" refers to one or more agents included in formulations to impart a desired consistency to the formulation and/or stabilization of formulation components. In some embodiments, bulking agents are included in lyophilized viral vector formulations to yield a "pharmaceutically elegant" cake, stabilizing the lyophilized viral vectors during long term (e.g. 36 month) storage. Bulking agents of the present invention may include, but are not limited to sucrose, trehalose, mannitol, glycine, lactose and/or raffinose. In some embodiments, combinations of cryoprotectants and bulking agents (for example, sucrose/glycine or trehalose/mannitol) may be included to both stabilize viral vectors during freezing and provide a bulking agent for lyophilization.

Inactive Ingredients

In some embodiments, chimeric polynucleotide formulations may comprise at least one excipient which is an inactive ingredient. As used herein, the term "inactive ingredient" refers to one or more inactive agents included in formulations. In some embodiments, all, none or some of the inactive ingredients which may be used in the formulations of the present invention may be approved by the US Food and Drug Administration (FDA).

Formulations of viral vectors disclosed herein may include cations or anions. In one embodiment, the formulations include metal cations such as, but not limited to, $Zn^{2+}$, $Ca^{2+}$, $Cu^{2+}$, $Mg^+$ and combinations thereof. As a non-limiting example, formulations may include polymers and a chimeric polynucleotides complexed with a metal cation (See e.g., U.S. Pat. Nos. 6,265,389 and 6,555,525, each of which is herein incorporated by reference in its entirety).

Administration

The viral vectors of the present invention may be administered by any route which results in a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal. In specific embodiments, compositions may be administered in a way which allows them cross the blood-brain barrier, vascular barrier, or other epithelial barrier. In one embodiment, a formulation for a route of administration may include at least one inactive ingredient.

Dosing

The present invention provides methods comprising administering viral vectors and their payload or complexes in accordance with the invention to a subject in need thereof. Viral vector pharmaceutical, imaging, diagnostic, or prophylactic compositions thereof, may be administered to a subject using any amount and any route of administration effective for preventing, treating, diagnosing, or imaging a disease, disorder, and/or condition (e.g., a disease, disorder, and/or condition relating to working memory deficits). The exact amount required will vary from subject to subject, depending on the species, age, and general condition of the subject, the severity of the disease, the particular composition, its mode of administration, its mode of activity, and the like. Compositions in accordance with the invention are typically formulated in unit dosage form for ease of administration and uniformity of dosage. It will be understood, however, that the total usage of the compositions of the present invention may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific payload employed; the duration of the treatment; drugs used in combination or coincidental with the specific compound employed; and like factors well known in the medical arts.

In certain embodiments, viral vector pharmaceutical compositions in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, prophylactic, or imaging effect (see e.g., the range of unit doses described in International Publication No WO2013078199, herein incorporated by reference in its entirety). In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. As used herein, a "split dose" is the division of single unit dose or total daily dose into two or more doses, e.g, two or more administrations of the single unit dose. As used herein, a "single unit dose" is a dose of any therapeutic administered in one dose/at one time/single route/single point of contact, i.e., single administration event. As used herein, a "total daily dose" is an amount given or prescribed in 24 hr period. It may be administered as a single unit dose. In one embodiment, the viral vectors of the present invention are administered to a subject in split doses. The viral vectors may be formulated in buffer only or in a formulation described herein.

A pharmaceutical composition described herein can be formulated into a dosage form described herein, such as a topical, intranasal, pulmonary, intratracheal, or injectable (e.g., intravenous, intraocular, intravitreal, intramuscular, intracardiac, intraperitoneal, subcutaneous).

Combinations

The viral vectors may be used in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, diagnostic, or imaging compositions in combination with agents that may improve their bioavailability, reduce and/or modify their metabolism, inhibit their excretion, and/or modify their distribution within the body.

Delivery Methods

In one embodiment, the viral vector may be administered or delivered using the methods for the delivery of AAV virions described in European Patent Application No. EP1857552, the contents of which are herein incorporated by reference in its entirety.

In one embodiment, the viral vector may be administered or delivered using the methods for delivering proteins using AAV vectors described in European Patent Application No. EP2678433, the contents of which are herein incorporated by reference in its entirety.

In one embodiment, the viral vector may be administered or delivered using the methods for delivering DNA molecules using AAV vectors described in U.S. Pat. No. 5,858,351, the contents of which are herein incorporated by reference in its entirety.

In one embodiment, the viral vector may be administered or delivered using the methods for delivering DNA to the bloodstream described in U.S. Pat. No. 6,211,163, the contents of which are herein incorporated by reference in its entirety.

In one embodiment, the viral vector may be administered or delivered using the methods for delivering AAV virions described in U.S. Pat. No. 6,325,998, the contents of which are herein incorporated by reference in its entirety.

In one embodiment, the viral vector may be administered or delivered using the methods for delivering DNA to muscle cells described in U.S. Pat. No. 6,335,011, the contents of which are herein incorporated by reference in its entirety.

In one embodiment, the viral vector may be administered or delivered using the methods for delivering DNA to muscle cells and tissues described in U.S. Pat. No. 6,610,290, the contents of which are herein incorporated by reference in its entirety.

In one embodiment, the viral vector may be administered or delivered using the methods for delivering DNA to muscle cells described in U.S. Pat. No. 7,704,492, the contents of which are herein incorporated by reference in its entirety.

In one embodiment, the viral vector may be administered or delivered using the methods for delivering a payload to skeletal muscles described in U.S. Pat. No. 7,112,321, the contents of which are herein incorporated by reference in its entirety.

In one embodiment, the viral vector may be administered or delivered using the methods for delivering a payload to the central nervous system described in U.S. Pat. No. 7,588,757, the contents of which are herein incorporated by reference in its entirety.

In one embodiment, the viral vector may be administered or delivered using the methods for delivering a payload described in U.S. Pat. No. 8,283,151, the contents of which are herein incorporated by reference in its entirety.

In one embodiment, the viral vector may be administered or delivered using the methods for delivering a payload for the treatment of Alzheimer disease described in U.S. Pat. No. 8,318,687, the contents of which are herein incorporated by reference in its entirety.

In one embodiment, the viral vector may be administered or delivered using the methods for delivering a payload described in International Patent Publication No. WO2012144446, the contents of which are herein incorporated by reference in its entirety.

In one embodiment, the viral vector may be administered or delivered using the methods for delivering a payload using a glutamic acid decarboxylase (GAD) delivery vector described in International Patent Publication No. WO2001089583, the contents of which are herein incorporated by reference in its entirety.

In one embodiment, the viral vector may be administered or delivered using the methods for delivering a payload described in International Patent Publication No. WO2001096587, the contents of which are herein incorporated by reference in its entirety.

In one embodiment, the viral vector may be administered or delivered using the methods for delivering a payload to muscle tissue described in International Patent Publication No. WO2002014487, the contents of which are herein incorporated by reference in its entirety.

In one embodiment, the viral vector may be administered or delivered using the methods for delivering a payload to neural cells described in International Patent Publication No. WO2012057363, the contents of which are herein incorporated by reference in its entirety.

The pharmaceutical compositions of viral vectors described herein may be characterized by one or more of bioavailability, therapeutic window and/or volume of distribution.

Bioavailability

Viral vectors of the present invention, when formulated into compositions with delivery/formulation agents or vehicles as described herein, may exhibit increased bioavailability as compared to compositions lacking delivery agents as described herein. As used herein, the term "bioavailability" refers to the systemic availability of a given amount of a particular agent administered to a subject. Bioavailability may be assessed by measuring the area under the curve (AUC) or the maximum serum or plasma concentration ($C_{max}$) of the unchanged form of a compound following administration of the compound to a mammal. AUC is a determination of the area under the curve plotting the serum or plasma concentration of a compound along the ordinate (Y-axis) against time along the abscissa (X-axis). Generally, the AUC for a particular compound may be calculated using methods known to those of ordinary skill in the art and as described in G. S. Banker, Modern Pharmaceutics, Drugs and the Pharmaceutical Sciences, v. 72, Marcel Dekker, New York, Inc., 1996, the contents of which are herein incorporated by reference in their entirety.

$C_{max}$ values are maximum concentrations of compounds achieved in serum or plasma of a subject following administration of compounds to the subject. $C_{max}$ values of particular compounds may be measured using methods known to those of ordinary skill in the art. As used herein, the phrases "increasing bioavailability" or "improving the pharmacokinetics," refer to actions that may increase the systemic availability of a viral vector of the present invention (as measured by AUC, $C_{max}$, or $C_{min}$) in a subject. In some embodiments, such actions may comprise co-administration with one or more delivery agents as described herein. In some embodiments, the bioavailability of viral vectors may increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or about 100%.

Therapeutic Window

Viral vectors of the present invention, when formulated with one or more delivery agents as described herein, may exhibit increases in the therapeutic window of compound and/or composition administration as compared to the therapeutic window of viral vectors administered without one or more delivery agents as described herein. As used herein, the term "therapeutic window" refers to the range of plasma concentrations, or the range of levels of therapeutically active substance at the site of action, with a high probability of eliciting a therapeutic effect. In some embodiments, therapeutic windows of viral vectors when administered in a formulation may increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or about 100%.

Volume of Distribution

Viral vectors of the present invention, when formulated with one or more delivery agents as described herein, may exhibit an improved volume of distribution ($V_{dist}$), e.g., reduced or targeted, relative to formulations lacking one or more delivery agents as described herein. $V_{dist}$ relates the amount of an agent in the body to the concentration of the same agent in the blood or plasma. As used herein, the term "volume of distribution" refers to the fluid volume that would be required to contain the total amount of an agent in the body at the same concentration as in the blood or plasma: $V_{dist}$ equals the amount of an agent in the body/concentration of the agent in blood or plasma. For example, for a 10 mg dose of a given agent and a plasma concentration of 10 mg/L, the volume of distribution would be 1 liter. The volume of distribution reflects the extent to which an agent is present in the extravascular tissue. Large volumes of distribution reflect the tendency of agents to bind to the tissue components as compared with plasma proteins. In clinical settings, $V_{dist}$ may be used to determine loading doses to achieve steady state concentrations. In some embodiments, volumes of distribution of viral vector compositions of the present invention when co-administered with one or more delivery agents as described herein may decrease at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%.

Kits and Devices

The invention provides a variety of kits for conveniently and/or effectively carrying out methods of the present invention. Typically kits will comprise sufficient amounts and/or numbers of components to allow a user to perform multiple treatments of a subject(s) and/or to perform multiple experiments.

In one aspect, the present invention provides kits comprising the molecules (viral vectors) of the invention. In one embodiment, the kit comprises one or more functional antibodies or function fragments thereof.

Said kits can be for viral vector production. The kit may further comprise packaging and instructions and/or a delivery agent to form a formulation composition. The delivery agent may comprise a saline, a buffered solution, or any delivery agent disclosed herein.

In one embodiment, the buffer solution may include sodium chloride, calcium chloride, phosphate and/or EDTA. In another embodiment, the buffer solution may include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium and mannose (See e.g., U.S. Pub. No. 20120258046; the contents of which are herein incorporated by reference in its entirety). In a further embodiment, the buffer solutions may be precipitated or it may be lyophilized. The amount of each component may be varied to enable consistent, reproducible higher concentration saline or simple buffer formulations. The components may also be varied in order to increase the stability of the viral vector or any expression construct taught herein in the buffer solution over a period of time and/or under a variety of conditions.

In one aspect, the present invention provides kits for viral vector production, comprising: an expression vector and a payload construct vector provided in an amount effective to produce a desired amount of a viral vector when introduced into a target cell and packaging and instructions.

Any of the vectors, constructs, polynucleotides or polypeptides of the present invention may be comprised in a kit. In some embodiments, kits may further include reagents and/or instructions for creating and/or synthesizing compounds and/or compositions of the present invention. In some embodiments, kits may also include one or more buffers. In some embodiments, kits of the invention may include components for making protein or nucleic acid arrays or libraries and thus, may include, for example, solid supports.

In some embodiments, kit components may be packaged either in aqueous media or in lyophilized form. The container means of the kits will generally include at least one vial, test tube, flask, bottle, syringe or other container means, into which a component may be placed, and preferably, suitably aliquotted. Where there are more than one kit component, (labeling reagent and label may be packaged together), kits may also generally contain second, third or other additional containers into which additional components may be separately placed. In some embodiments, kits may also comprise second container means for containing sterile, pharmaceutically acceptable buffers and/or other diluents. In some embodiments, various combinations of components may be comprised in one or more vial. Kits of the present invention may also typically include means for containing compounds and/or compositions of the present invention, e.g., proteins, nucleic acids, and any other reagent containers in close confinement for commercial sale. Such containers may include injection or blow-molded plastic containers into which desired vials are retained.

In some embodiments, kit components are provided in one and/or more liquid solutions. In some embodiments, liquid solutions are aqueous solutions, with sterile aqueous solutions being particularly preferred. In some embodiments, kit components may be provided as dried powder(s). When reagents and/or components are provided as dry powders, such powders may be reconstituted by the addition of suitable volumes of solvent. In some embodiments, it is envisioned that solvents may also be provided in another container means. In some embodiments, labeling dyes are provided as dried powders. In some embodiments, it is contemplated that 10, 20, 30, 40, 50, 60, 70, 80, 90, 100, 120, 120, 130, 140, 150, 160, 170, 180, 190, 200, 300, 400, 500, 600, 700, 800, 900, 1000 micrograms or at least or at most those amounts of dried dye are provided in kits of the invention. In such embodiments, dye may then be resuspended in any suitable solvent, such as DMSO.

In some embodiments, kits may include instructions for employing kit components as well the use of any other reagent not included in the kit. Instructions may include variations that may be implemented.

Devices

In some embodiments, compounds and/or compositions of the present invention may be combined with, coated onto or embedded in a device. Devices may include, but are not limited to, dental implants, stents, bone replacements, artificial joints, valves, pacemakers and/or other implantable therapeutic device.

The present invention provides for devices which may incorporate viral vectors that encode one or more payload molecules. These devices contain in a stable formulation the viral vectors which may be immediately delivered to a subject in need thereof, such as a human patient.

Devices for administration may be employed to deliver the viral vectors of the present invention according to single, multi- or split-dosing regimens taught herein.

Method and devices known in the art for multi-administration to cells, organs and tissues are contemplated for use in conjunction with the methods and compositions disclosed herein as embodiments of the present invention. These include, for example, those methods and devices having multiple needles, hybrid devices employing for example lumens or catheters as well as devices utilizing heat, electric current or radiation driven mechanisms.

In one embodiment, the chimeric polynucleotide is administered subcutaneously or intramuscularly via at least 3 needles to three different, optionally adjacent, sites simultaneously, or within a 60 minutes period (e.g., administration to 4,5, 6, 7, 8, 9, or 10 sites simultaneously or within a 60 minute period).

VI. Definitions

At various places in the present specification, substituents of compounds of the present disclosure are disclosed in groups or in ranges. It is specifically intended that the present disclosure include each and every individual subcombination of the members of such groups and ranges. The following is a non-limiting list of term definitions.

Activity: As used herein, the term "activity" refers to the condition in which things are happening or being done. Compositions of the invention may have activity and this activity may involve one or more biological events.

Administered in combination: As used herein, the term "administered in combination" or "combined administration" refers to simultaneous exposure of one or more subjects to two or more agents administered at the same time or within an interval such that the subject is at some point in time simultaneously exposed to both and/or such that there may be an overlap in the effect of each agent on the patient. In some embodiments, at least one dose of one or more agents is administered within about 24 hours, 12 hours, 6 hours, 3 hours, 1 hour, 30 minutes, 15 minutes, 10 minutes, 5 minutes, or 1 minute of at least one dose of one or more other agents. In some embodiments, administration occurs in overlapping dosage regimens. As used herein, the term "dosage regimen" refers to a plurality of doses spaced apart in time. Such doses may occur at regular intervals or may include one or more hiatus in administration. In some embodiments, the administration of individual doses of one or more compounds and/or compositions of the present invention, as described herein, are spaced sufficiently closely together such that a combinatorial (e.g., a synergistic) effect is achieved.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, mean that the moieties are physically associated or connected with one another, either directly or via one or more additional moieties that serve as linking agents, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Biomolecule: As used herein, the term "biomolecule" is any natural molecule which is amino acid-based, nucleic acid-based, carbohydrate-based or lipid-based, and the like.

Biologically active: As used herein, the phrase "biologically active" refers to a characteristic of any substance that has activity in or on a biological system and/or organism. For instance, a substance that, when administered to an organism, has a biological effect on that organism, is considered to be biologically active. In particular embodiments, a compounds and/or compositions of the present invention may be considered biologically active if even a portion of is biologically active or mimics an activity considered to biologically relevant.

Biological system: As used herein, the term "biological system" refers to a group of organs, tissues, cells, intracellular components, proteins, nucleic acids, molecules (including, but not limited to biomolecules) that function together to perform a certain biological task within cellular membranes, cellular compartments, cells, tissues, organs, organ systems, multicellular organisms, or any biological entity. In some embodiments, biological systems are cell signaling pathways comprising intracellular and/or extracellular cell signaling biomolecules. In some embodiments, biological systems comprise growth factor signaling events within the extracellular/cellular matrix and/or cellular niches.

Compound: As used herein, the term "compound," refers to a distinct chemical entity. In some embodiments, a particular compound may exist in one or more isomeric or isotopic forms (including, but not limited to stereoisomers, geometric isomers and isotopes). In some embodiments, a compound is provided or utilized in only a single such form. In some embodiments, a compound is provided or utilized as a mixture of two or more such forms (including, but not limited to a racemic mixture of stereoisomers). Those of skill in the art appreciate that some compounds exist in different such forms, show different properties and/or activities (including, but not limited to biological activities). In such cases it is within the ordinary skill of those in the art to select or avoid particular forms of the compound for use in accordance with the present invention. For example, compounds that contain asymmetrically substituted carbon atoms can be isolated in optically active or racemic forms. Methods on how to prepare optically active forms from optically active starting materials are known in the art, such as by resolution of racemic mixtures or by stereoselective synthesis.

Conserved: As used herein, the term "conserved" refers to nucleotides or amino acid residues of polynucleotide or polypeptide sequences, respectively, that are those that occur unaltered in the same position of two or more sequences being compared. Nucleotides or amino acids that are relatively conserved are those that are conserved among more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an oligonucleotide or polypeptide or may apply to a portion, region or feature thereof.

In one embodiment, conserved sequences are not contiguous. Those skilled in the art are able to appreciate how to achieve alignment when gaps in contiguous alignment are present between sequences, and to align corresponding residues not withstanding insertions or deletions present.

Delivery: As used herein, "delivery" refers to the act or manner of delivering a compound, substance, entity, moiety, cargo or payload to a target. Such target may be a cell, tissue, organ, organism, or system (whether biological or production).

Delivery Agent: As used herein, "delivery agent" refers to any agent which facilitates, at least in part, the in vivo delivery of one or more substances (including, but not limited to a compounds and/or compositions of the present invention, e.g., viral vectors or expression vectors) to targeted cells.

Destabilized: As used herein, the term "destable," "destabilize," or "destabilizing region" means a region or molecule that is less stable than a starting, reference, wild-type or native form of the same region or molecule.

Detectable label: As used herein, "detectable label" refers to one or more markers, signals, or moieties which are attached, incorporated or associated with another entity, which markers, signals or moieties are readily detected by methods known in the art including radiography, fluorescence, chemiluminescence, enzymatic activity, absorbance, immunological detection and the like. Detectable labels may include radioisotopes, fluorophores, chromophores, enzymes, dyes, metal ions, ligands, biotin, avidin, streptavidin and haptens, quantum dots, polyhistidine tags, myc tags, flag tags, human influenza hemagglutinin (HA) tags and the like. Detectable labels may be located at any position in the entity with which they are attached, incorporated or associated. For example, when attached, incorporated in or associated with a peptide or protein, they may be within the amino acids, the peptides, or proteins, or located at the N- or C-termini.

Distal: As used herein, the term "distal" means situated away from the center or away from a point or region of interest.

Engineered: As used herein, embodiments of the invention are "engineered" when they are designed to have a feature or property, whether structural or chemical, that varies from a starting point, wild type or native molecule. Thus, engineered agents or entities are those whose design and/or production include an act of the hand of man.

Epitope: As used herein, an "epitope" refers to a surface or region on a molecule that is capable of interacting with a biomolecule. For example a protein may contain one or more amino acids, e.g., an epitope, which interacts with an antibody, e.g., a biomolecule. In some embodiments, when referring to a protein or protein module, an epitope may comprise a linear stretch of amino acids or a three dimensional structure formed by folded amino acid chains.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; (4) folding of a polypeptide or protein; and (5) post-translational modification of a polypeptide or protein.

Feature: As used herein, a "feature" refers to a characteristic, a property, or a distinctive element.

Formulation: As used herein, a "formulation" includes at least a compound and/or composition of the present invention and a delivery agent.

Fragment: A "fragment," as used herein, refers to a contiguous portion of a whole. For example, fragments of proteins may comprise polypeptides obtained by digesting full-length protein isolated from cultured cells. In some embodiments, a fragment of a protein includes at least 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250 or more amino acids. In some embodiments, fragments of an antibody include portions of an antibody subjected to enzymatic digestion or synthesized as such.

Functional: As used herein, a "functional" biological molecule is a biological entity with a structure and in a form in which it exhibits a property and/or activity by which it is characterized.

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is typically determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids. In many embodiments, homologous protein may show a large overall degree of homology and a high degree of homology over at least one short stretch of at least 3, 4, 5, 6, 7, 8, 9, 10, 11, 12, 13, 14, 15, 16, 17, 18, 19, 20, 25, 30, 35, 40, 45, 50 or more amino acids. In many embodiments, homologous proteins share one or more characteristic sequence elements. As used herein, the term "characteristic sequence element" refers to a motif present in related proteins. In some embodiments, the presence of such motifs correlates with a particular activity (such as biological activity).

Identity: As used herein, the term "identity" refers to the overall relatedness between polymeric molecules, e.g., between oligonucleotide molecules (e.g. DNA molecules and/or RNA molecules) and/or between polypeptide molecules. Calculation of the percent identity of two polynucleotide sequences, for example, may be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined, for example using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research,* 12(1), 387 (1984)), BLASTP, BLASTN, and FASTA Altschul, S. F. et al., *J. Molec. Biol.,* 215, 403 (1990)).

Inhibit expression of a gene: As used herein, the phrase "inhibit expression of a gene" means to cause a reduction in the amount of an expression product of the gene. The expression product may be RNA transcribed from the gene (e.g. mRNA) or a polypeptide translated from mRNA transcribed from the gene. Typically a reduction in the level of mRNA results in a reduction in the level of a polypeptide translated therefrom. The level of expression may be determined using standard techniques for measuring mRNA or protein.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" is synonymous with "separated", but carries with it the inference separation was carried out by the hand of man. In one embodiment, an isolated substance or entity is one that has been separated from at least some of the components with which it was previously associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art. In some embodiments, isolation of a substance or entity includes disruption of chemical associations and/or bonds. In some embodiments, isolation includes only the separation from components with which the isolated substance or entity was previously combined and does not include such disruption.

Linker: As used herein, a linker refers to a moiety that connects two or more domains, moieties or entities. In one embodiment, a linker may comprise 10 or more atoms. In a further embodiment, a linker may comprise a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. In some embodiments, a linker may comprise one or more nucleic acids comprising one or more nucleotides. In some embodiments, the linker may comprise an amino acid, peptide, polypeptide or protein. In some embodiments, a moiety bound by a linker may include, but is not limited to an atom, a chemical group, a nucleoside, a nucleotide, a nucleobase, a sugar, a nucleic acid, an amino acid, a peptide, a polypeptide, a protein, a protein complex, a payload (e.g., a therapeutic agent). or a marker (including, but not limited to a chemical, fluorescent, radioactive or bioluminescent marker). The linker can be used for any useful purpose, such as to form multimers or conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bonds include an amido bond which may be cleaved for example by the use of tris(2-carboxyethyl)phosphine (TCEP), or other reducing agents, and/or photolysis, as well as an ester bond which may be cleaved for example by acidic or basic hydrolysis.

Modified: As used herein, the term "modified" refers to a changed state or structure of a molecule or entity as compared with a parent or reference molecule or entity. Molecules may be modified in many ways including chemically, structurally, and functionally. In some embodiments, compounds and/or compositions of the present invention are modified by the introduction of non-natural amino acids.

Mutation: As used herein, the term "mutation" refers to a change and/or alteration. In some embodiments, mutations may be changes and/or alterations to proteins (including peptides and polypeptides) and/or nucleic acids (including polynucleic acids). In some embodiments, mutations comprise changes and/or alterations to a protein and/or nucleic acid sequence. Such changes and/or alterations may comprise the addition, substitution and or deletion of one or more amino acids (in the case of proteins and/or peptides) and/or nucleotides (in the case of nucleic acids and or polynucleic acids). In embodiments wherein mutations comprise the addition and/or substitution of amino acids and/or nucleotides, such additions and/or substitutions may comprise 1 or more amino acid and/or nucleotide residues and may include modified amino acids and/or nucleotides.

Naturally occurring: As used herein, "naturally occurring" means existing in nature without artificial aid, or involvement of the hand of man.

Non-human vertebrate: As used herein, a "non-human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Off-target: As used herein, "off target" refers to any unintended effect on any one or more target, gene and/or cellular transcript.

Operably linked: As used herein, the phrase "operably linked" refers to a functional connection between two or more molecules, constructs, transcripts, entities, moieties or the like.

Patient: As used herein, "patient" refers to a subject who may seek or be in need of treatment, requires treatment, is receiving treatment, will receive treatment, or a subject who is under care by a trained (e.g., licensed) professional for a particular disease or condition.

Peptide: As used herein, the term "peptide" refers to a chain of amino acids that is less than or equal to about 50 amino acids long, e.g., about 5, 10, 15, 20, 25, 30, 35, 40, 45, or 50 amino acids long.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: As used herein, the term "pharmaceutically acceptable excipient," as used herein, refers to any ingredient other than active agents (e.g., as described herein) present in pharmaceutical compositions and having the properties of being substantially nontoxic and non-inflammatory in subjects. In some embodiments, pharmaceutically acceptable excipients are vehicles capable of suspending and/or dissolving active agents. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, cross-linked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: Pharmaceutically acceptable salts of the compounds described herein are forms of the disclosed compounds wherein the acid or base moiety is in its salt form (e.g., as generated by reacting a free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. Pharmaceutically acceptable salts include the conventional non-toxic salts, for example, from non-toxic inorganic or organic acids. In some embodiments a pharmaceutically acceptable salt is prepared from a parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17$^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety. Pharmaceutically acceptable solvate: The term "pharmaceutically acceptable solvate," as used herein, refers to a crystalline form of a compound wherein molecules of a suitable solvent are incorporated in the crystal lattice. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate." In some embodiments, the solvent incorporated into a solvate is of a type or at a level that is physiologically tolerable to an organism to which the solvate is administered (e.g., in a unit dosage form of a pharmaceutical composition).

Pharmacokinetic: As used herein, "pharmacokinetic" refers to any one or more properties of a molecule or compound as it relates to the determination of the fate of substances administered to living organisms. Pharmacokinetics are divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Proliferate: As used herein, the term "proliferate" means to grow, expand, replicate or increase or cause to grow, expand, replicate or increase. "Proliferative" means having the ability to proliferate. "Anti-proliferative" means having properties counter to or in opposition to proliferative properties.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Purified: As used herein, the term "purify" means to make substantially pure or clear from unwanted components, material defilement, admixture or imperfection. "Purified" refers to the state of being pure. "Purification" refers to the process of making pure.

Region: As used herein, the term "region" refers to a zone or general area. In some embodiments, when referring to a protein or protein module, a region may comprise a linear sequence of amino acids along the protein or protein module or may comprise a three dimensional area, an epitope and/or a cluster of eptiopes. In some embodiments, regions comprise terminal regions. As used herein, the term "terminal region" refers to regions located at the ends or termini of a given agent. When referring to proteins, terminal regions may comprise N- and/or C-termini. N-termini refer to the end of a protein comprising an amino acid with a free amino group. C-termini refer to the end of a protein comprising an amino acid with a free carboxyl group. N- and/or C-terminal regions may there for comprise the N- and/or C-termini as well as surrounding amino acids. In some embodiments, N- and/or C-terminal regions comprise from about 3 amino acid to about 30 amino acids, from about 5 amino acids to about 40 amino acids, from about 10 amino acids to about 50 amino acids, from about 20 amino acids to about 100 amino acids and/or at least 100 amino acids. In some embodiments, N-terminal regions may comprise any length of amino acids that includes the N-terminus, but does not include the C-terminus. In some embodiments, C-terminal regions may comprise any length of amino acids, which include the C-terminus, but do not comprise the N-terminus.

Sample: As used herein, the term "sample" refers to an aliquot or portion taken from a source and/or provided for analysis or processing. In some embodiments, a sample is from a biological source such as a tissue, cell or component part (e.g. a body fluid, including but not limited to blood, mucus, lymphatic fluid, synovial fluid, cerebrospinal fluid, saliva, amniotic fluid, amniotic cord blood, urine, vaginal fluid and semen). In some embodiments, a sample may be or comprise a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. In some embodiments, a sample is or comprises a medium, such as a nutrient broth or gel, which may contain cellular components, such as proteins or nucleic acid molecule. In some embodiments, a "primary" sample is an aliquot of the source. In some embodiments, a primary sample is subjected to one or more processing (e.g., separation, purification, etc.) steps to prepare a sample for analysis or other use.

Signal Sequences: As used herein, the phrase "signal sequences" refers to a sequence which can direct the transport or localization.

Single unit dose: As used herein, a "single unit dose" is a dose of any therapeutic administered in one dose/at one time/single route/single point of contact, i.e., single administration event. In some embodiments, a single unit dose is provided as a discrete dosage form (e.g., a tablet, capsule, patch, loaded syringe, vial, etc.).

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound or entity that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable. In some embodiments, stability is measured relative to an absolute value. In some embodiments, stability is measured relative to a reference compound or entity.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term typically means within about 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Synthetic: The term "synthetic" means produced, prepared, and/or manufactured by the hand of man. Synthesis of polynucleotides or polypeptides or other molecules of the present invention may be chemical or enzymatic.

Targeted Cells: As used herein, "targeted cells" refers to any one or more cells of interest. The cells may be found in vitro, in vivo, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose. In some embodiments, a therapeutically effective amount is administered in a dosage regimen comprising a plurality of doses. Those skilled in the art will appreciate that in some embodiments, a unit dosage form may be considered to comprise a therapeutically effective amount of a particular agent or entity if it comprises an amount that is effective when administered as part of such a dosage regimen.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in a 24 hr period. It may be administered as a single unit dose.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in any way. Unmodified may, but does not always, refer to the wild type or native form of a biomolecule or entity. Molecules or entities may undergo a series of modifications whereby each modified product may serve as the "unmodified" starting molecule or entity for a subsequent modification.

Equivalents and Scope

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

VII. Examples

Example 1

Recombinant AAV Production in Invertebrate Cells

The AAV viral expression construct encodes the three structural cap proteins, VP1, VP2, and VP3, in a single open reading frame regulated by utilization of both alternative splice acceptor and non-canonical translational initiation codon(s). In-frame and out-of-frame ATG triplets preventing translation initiation at a position between the VP1 and VP2 start codons are eliminated. Both Rep 78 and Rep 52 are translated from a single transcript: Rep 78 translation initiates at a non-AUG codon and Rep 52 translation initiates at the first AUG in the transcript.

The nucleotides that encode the structural VP1, VP2, and VP3 capsid proteins and non-structural Rep78 and Rep 52 proteins are contained on one viral expression construct under control of the baculovirus major late promoter.

The payload construct vector encodes two ITR sequences flanking a transgene, polynucleotide encoding a polypeptide or modulatory nucleic acid. The ITR sequences allow for replication of a polynucleotide encoding the transgene and ITR sequences alone that will be packaged within the capsid of the viral vector.

A seed culture of Sf9 cells in serum free suspension culture is co-transfected with the payload construct vector and the viral expression construct. The culture is maintained for 48 hours while two baculoviruses are produced and released into the medium, one containing the payload construct vector and a second containing the viral expression construct. The baculovirus released into the media continue to infect Sf9 cells in an exponential manner until all of the Sf9 cells in the culture are infected at least once with both baculoviruses. In each viral replication cell that has been infected with both baculoviruses the payload flanked on either end with an ITR sequence is replicated and packaged in a capsid assembled from the proteins VP1, VP2, and VP3. The cells and media of the seed culture is harvested and divided into aliquots before being frozen in liquid nitrogen.

A naïve population of un-transfected Sf9 cells is expanded in serum free suspension cell culture conditions. Once the culture growth has reached peak log phase in 1 L of media as measured by optical density the culture is added to a large volume 20 L bioreactor. The bioreactor culture is inoculated with a frozen aliquot from the baculovirus seed culture. The conditions of the Sf9 cell suspension culture is monitored by instruments that measure and/or control external variables that support the growth and activity of viral replication cells such as mass, temperature, $CO_2$, $O_2$, pH, and/or optical density (OD). The Sf9 culture is maintained at optimal conditions until cell population growth has reached peak log phase and before cell growth has plateaued, as measured by optical density.

The viral replication cells are lysed using the Microfluidizer™ (Microfluidics International Corp., Newton, Mass.), high shear force fluid processor. The resultant cell lysate is clarified by low speed centrifugation followed by tangential flow filtration. The resultant clarified lysate is filtered by a size exclusion column to remove any remaining baculoviral particles from solution. The final steps utilize ultracentrifugation and sterile filtration to produce viral vectors suitable for use as described herein.

Example 2

Recombinant AAV Production in Mammalian Cells

The AAV viral expression construct encodes the three structural cap proteins, VP1, VP2, and VP3, in a single open reading frame regulated by utilization of both alternative splice acceptor and non-canonical translational initiation codon(s). In-frame and out-of-frame ATG triplets preventing translation initiation at a position between the VP1 and VP2 start codons are eliminated. Both Rep 78 and Rep 52 are translated from a single transcript: Rep 78 translation initiates at a non-AUG codon and Rep 52 translation initiates at the first AUG in the transcript.

The nucleotides that encode the structural VP1, VP2, and VP3 capsid proteins and non-structural Rep78 and Rep 52 proteins are contained on one viral expression construct under control of the CMV promoter.

The payload construct vector encodes two ITR sequences flanking the payload, e.g., a transgene, polynucleotide encoding a polypeptide or modulatory nucleic acid molecule. The ITR sequences allow for replication of a polynucleotide encoding the payload and ITR sequences that will be packaged within the capsid of the viral vector.

A seed culture of Chinese Hamster Ovary (CHO) cells adapted for growth in serum free suspension culture is co-transfected with the payload construct vector and the viral expression construct. The culture is maintained for 48 hours while two baculoviruses are produced and released into the medium, one containing the payload construct vector and a second containing the viral expression construct. The baculovirus released into the media continue to infect CHO cells in an exponential manner until all of the CHO cells in the culture are infected at least once with both baculoviruses. In each viral replication cell that has been infected with both baculoviruses the payload flanked on either end with an ITR sequence is replicated and packaged in a capsid assembled from the proteins VP1, VP2, and VP3. The cells and media of the seed culture is harvested and divided into aliquots before being frozen in, for example, liquid nitrogen.

A naïve population of un-transfected CHO cells is expanded in serum free suspension cell culture conditions. Once the culture growth has reached peak log phase in 1 L of media as measured by optical density the culture is added to a large volume 20 L bioreactor. The bioreactor culture is inoculated with a frozen aliquot from the baculovirus seed culture. The conditions of the CHO cell suspension culture is monitored by instruments that measure and/or control external variables that support the growth and activity of viral replication cells such as mass, temperature, CO2, O2, pH, and/or optical density (OD). The CHO culture is maintained at optimal conditions until cell population growth has reached peak log phase and before cell growth has plateaued, as measured by optical density.

The viral replication cells are lysed using the Microfluidizer™ (Microfluidics International Corp., Newton, Mass.), high shear force fluid processor. The resultant cell lysate is clarified by low speed centrifugation followed by tangential flow filtration. The resultant clarified lysate is filtered by a size exclusion column to remove any remaining baculoviral particles from solution. The final steps utilize ultracentrifugation and sterile filtration to produce viral vector suitable for uses described herein.

Example 3

Large Scale PEI Transfection

Polyethyleneimine (PEI) is used to form PEI-DNA complexes. Plasmids being transfected are combined with PEI in PBS and allowed to incubate at room temperature for 10 minutes. HEK 293 cell cultures being transfected are 'shocked' at 4° C. for 1 hour before being returned to the 37° C. incubator for a period of 6-24 hours (to arrest cell cycle at the junction between G2 phase and M phase.) PEI-DNA transfection complexes are then added to the cells under shaking conditions and allowed to incubate 6 hours. After incubation, an equal volume of fresh medium is added and cells are incubated for 24-96 hours.

Example 4

Chimeric Capsid Design

Figure 4:
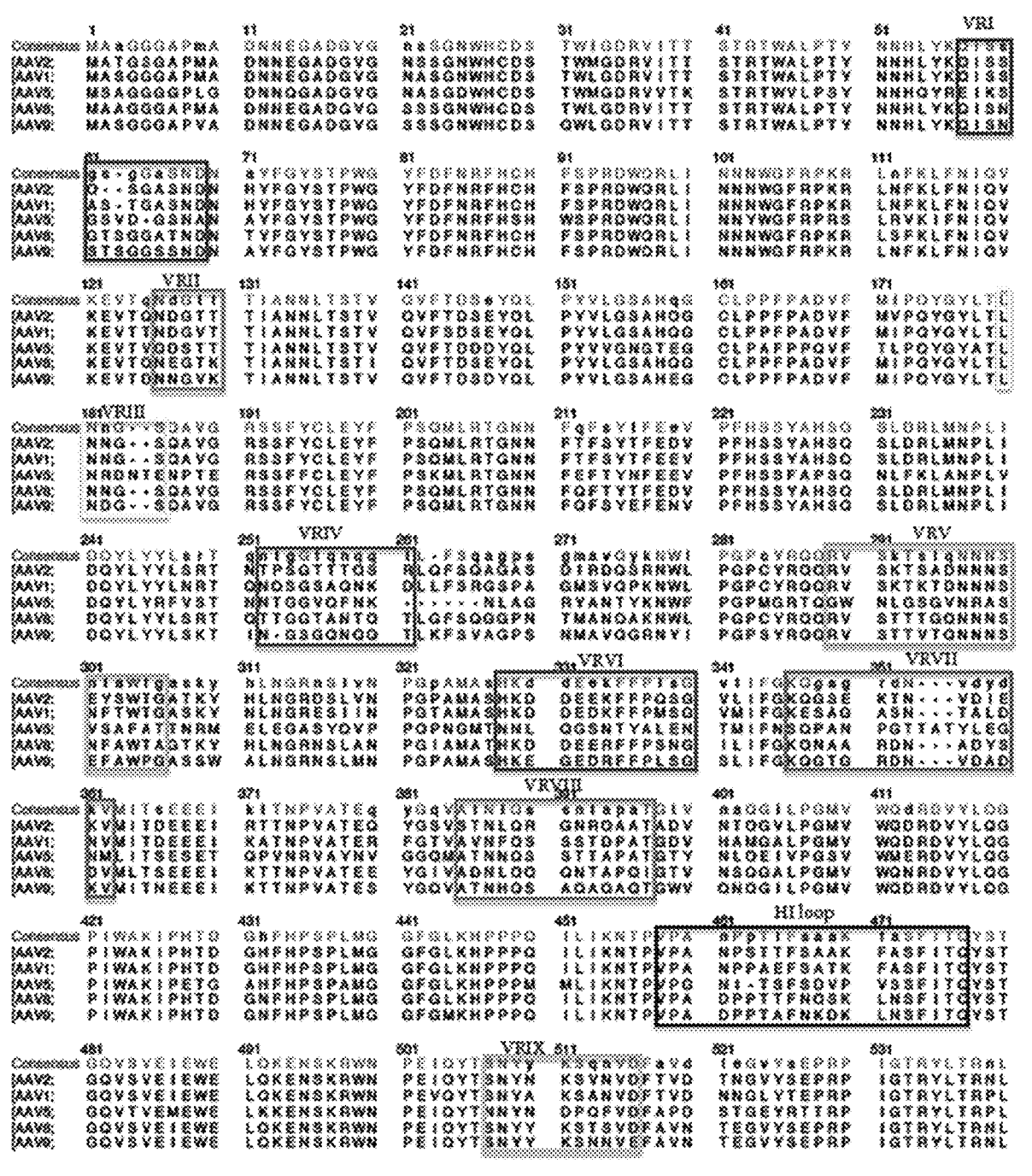
Figure 5:
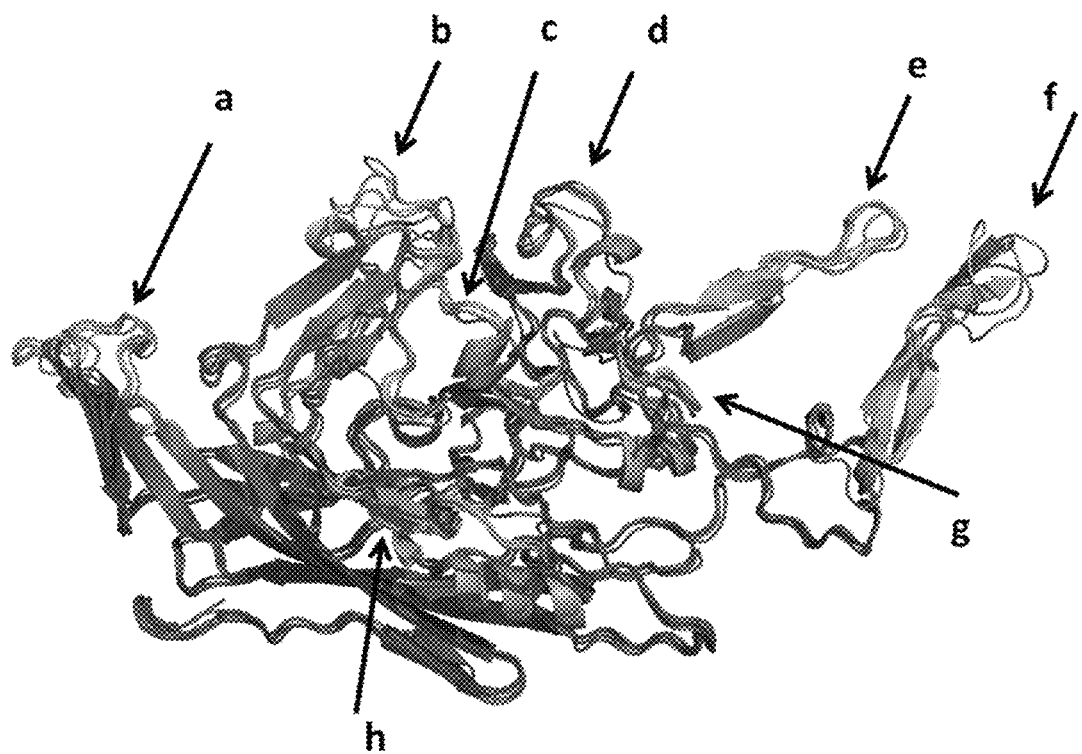
FIG. 5 is a 3-dimensional protein backbone overlay diagram of certain AAV capsid sequences of FIG. 4. The black arrows indicate variable regions (VR) that are visible in one rotational aspect, and these are arbitrarily labeled a-h.

For chimeric capsid design, an alignment of cap nucleotide sequences from AAV variants was constructed to identify variable regions (VR) at the sequence level (FIG. 4). Additionally, an alignment of capsid protein structures from AAV variants was constructed to identify variable regions (VR) at the structural level (FIG. 5). An analysis of the correlation between structural features of the capsid and the degree of conservation of the sequence was performed. Based on this sequence and structural alignments of AAV capsids, ten VR were identified as regions of interest (eight are shown in FIG. 5, a-h), including nine previously undescribed regions of structural definition and regions of a structural element known as the HI loop.

Figure 8:
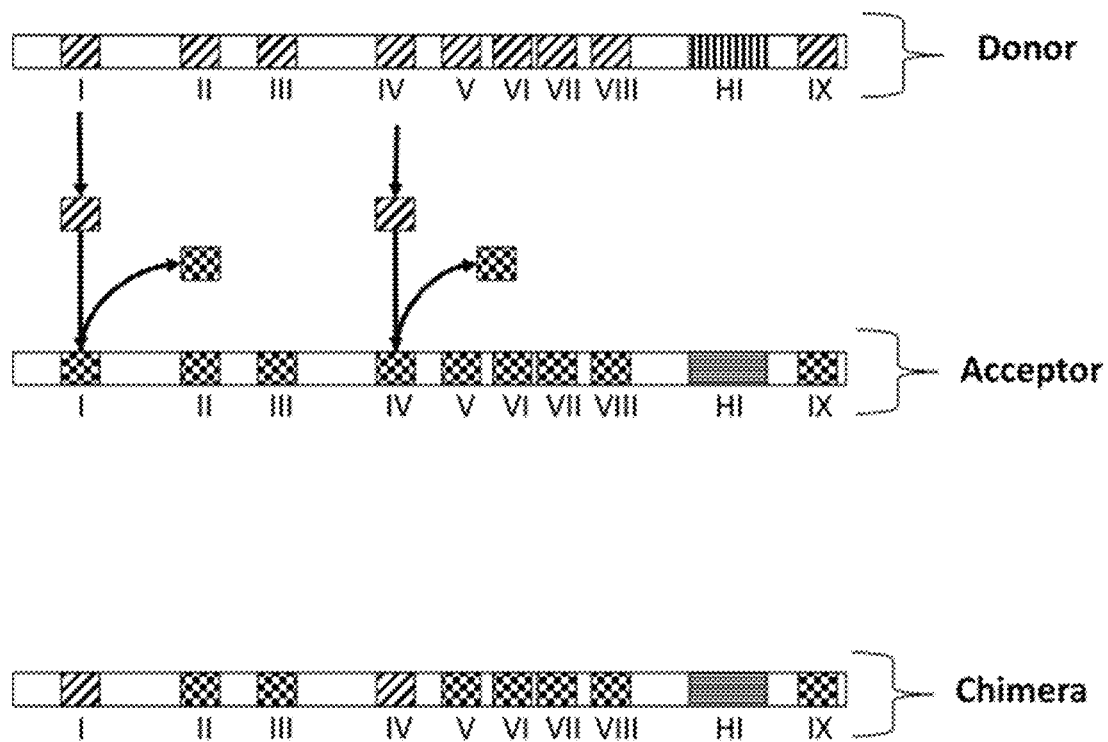
FIG. 8 is a schematic illustrating one embodiment of chimeric capsid engineering involving a region from a donor sequence inserted into an acceptor capsid to produce a resultant chimera. Variable regions and the HI loop are depicted using hashed and/or checkered fill.

In on embodiment, chimeric capsid design is achieved such that chimeras are designed where one or more VR from a cap gene from a donor sequence is swapped (either the entire VR or subsets of the VR) with a VR from a cap gene in an acceptor sequence. This design scheme is shown in FIG. 8.

Example 5

CNS Specific Chimeric Capsid Design

Figure 6:
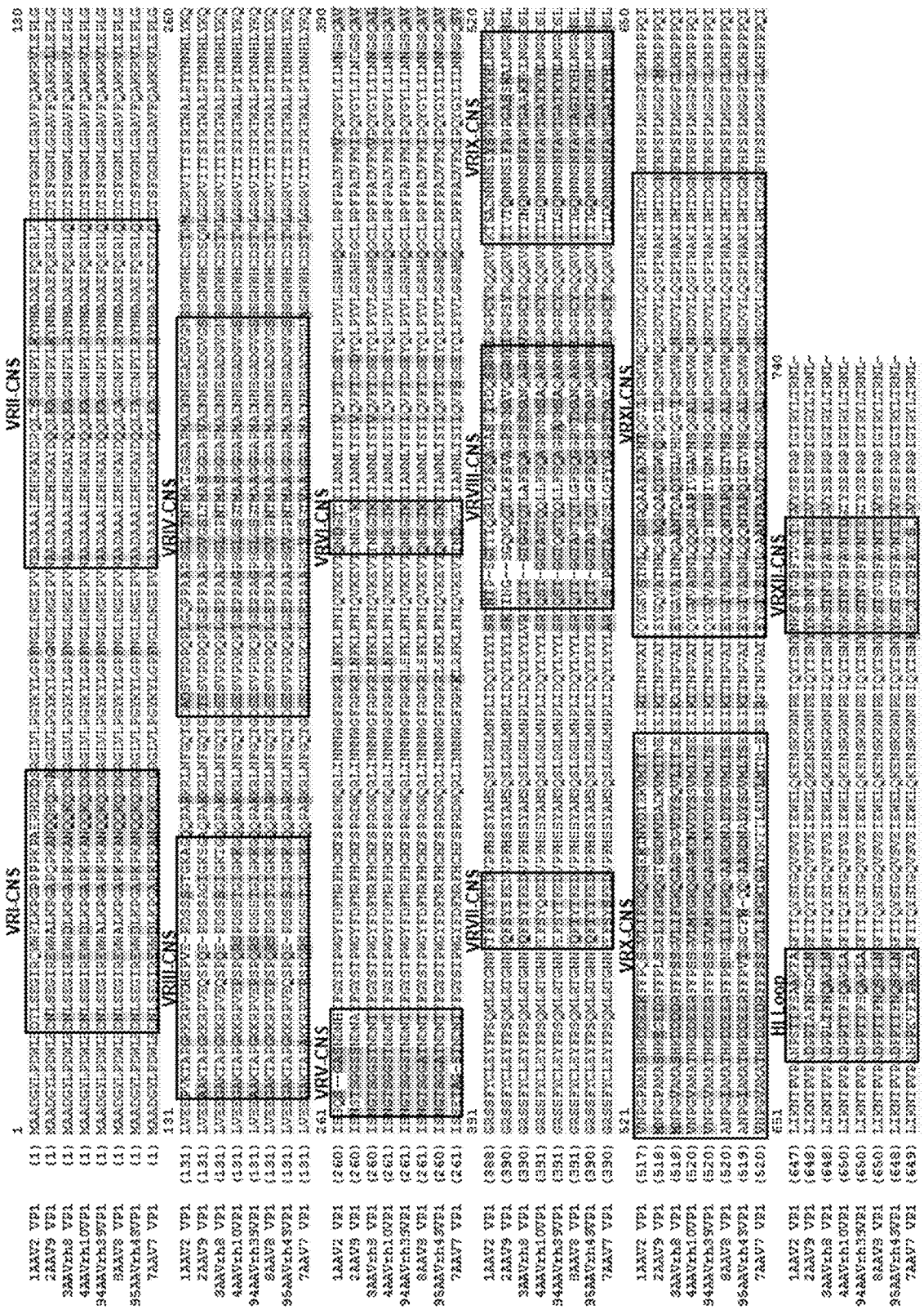
FIG. 6 is a protein alignment of VP1 sequences from selected AAV capsids with central nervous system (CNS) tropism aligned to AAV2 (SEQ ID NO: 435), including AAV7 (SEQ ID NO: 442), AAV8 (SEQ ID NO: 440), AAVrh8 (SEQ ID NO: 437), AAV9 (SEQ ID NO: 436), AAVrh10 (SEQ ID NO: 438), AAVrh39 (SEQ ID NO: 439), and AAVrh43 (SEQ ID NO: 441), showing structural variable regions (VR) designated VRI-CNS to VRXII-CNS.
Figure 7:
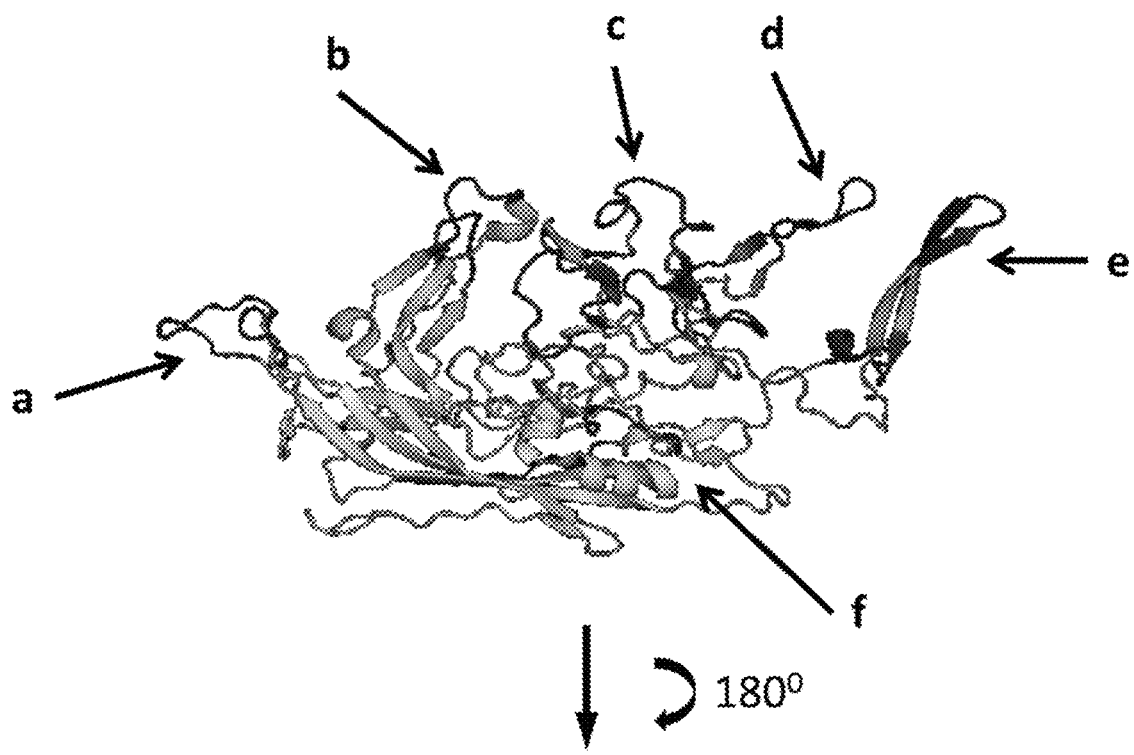
FIG. 7 is a 3-dimensional protein backbone overlay diagram of certain AAV capsid sequences of FIG. 6. The red arrows indicate variable regions (VR) that are visible in one or two rotational aspects, and these VRs are arbitrarily labeled a-l.
Figure 7:
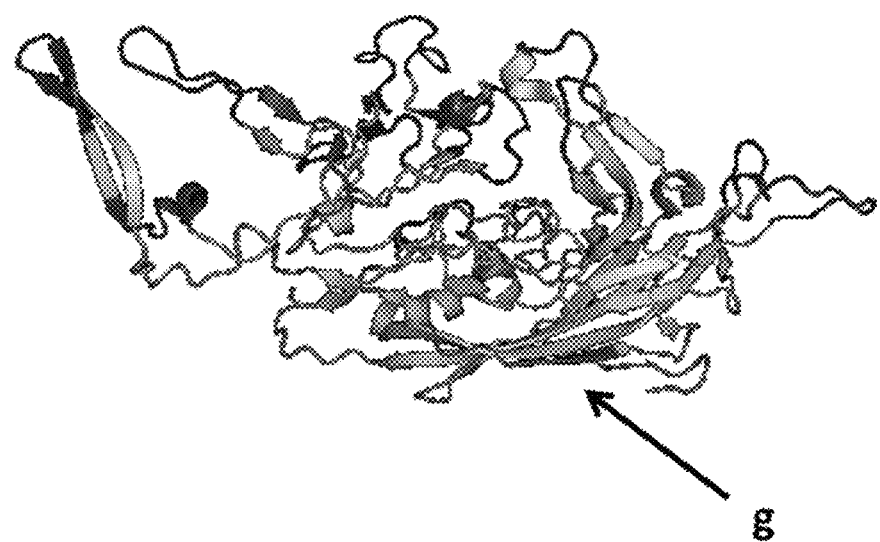

For CNS specific chimeric capsid design, an alignment of cap nucleotide sequences from AAV variants exhibiting CNS tropism was constructed to identify variable regions (VR) at the sequence level (FIG. 6). Additionally, an alignment of capsid protein structures from AAV variants exhibiting CNS tropism was constructed to identify variable regions (VR) at the structural level (FIG. 7). An analysis of the correlation between structural features of the capsid and the degree of conservation of the sequence was performed. Based on this sequence and structural alignments of AAV capsids, twelve VR were identified as regions of interest (seven are shown in FIG. 7, a-g), including previously undescribed regions of structural definition and regions of a structural element known as the HI loop.

In on embodiment, chimeric capsid design is achieved such that chimeras are designed where one or more VR from a cap gene from a donor sequence is swapped (either the entire VR or subsets of the VR) with a VR from a cap gene in an acceptor sequence. This design scheme is shown in FIG. 8.

Example 6

Chimeric Capsid Variants

Chimeric capsids were designed based on a series of donor, e.g., parent or reference sequences from publicly available sequences. Table 9 lists capsid proteins that were used as donor sequences and or the variants designed from them. In the table, the parent or reference sequences include either a GenBank sequence reference or a pdb reference from the crystal structure where the variants designed list only a VOY ID number.

TABLE 9

| AAV Capsid Variants | |
|---|---|
| VOY ID | SEQ ID NO. |
| VOY1 | 300 |
| VOY2 | 301 |
| VOY3 | 300 |
| VOY4 | 302 |
| VOY5 | 303 |
| VOY6 | 304 |
| VOY7 | 305 |
| VOY8 | 306 |
| VOY9 | 307 |
| VOY10 | 308 |
| VOY11 | 309 |
| VOY12 | 310 |
| VOY13 | 311 |
| VOY14 | 312 |
| VOY15 | 313 |
| VOY16 | 314 |
| VOY17 | 315 |
| VOY18 | 36 |
| VOY19 | 312 |
| AAV6 (AAB95450.1) | 317 |
| VOY20 | 318 |
| VOY21 | 319 |
| VOY22 | 320 |
| VOY23 | 321 |
| VOY24 | 322 |
| VOY25 | 323 |
| VOY26 | 324 |
| VOY27 | 325 |
| VOY28 | 326 |
| VOY29 | 327 |
| VOY30 | 328 |
| VOY31 | 329 |
| VOY32 | 330 |
| AAV9 (AAS99264.1) | 331 |
| VOY33 | 332 |
| VOY34 | 333 |
| VOY35 | 334 |
| VOY36 | 335 |
| VOY37 | 336 |
| VOY38 | 337 |
| VOY39 | 338 |
| VOY40 | 338 |
| VOY41 | 339 |
| VOY42 | 340 |
| VOY43 | 341 |
| VOY44 | 342 |
| VOY45 | 343 |
| VOY46 | 344 |
| VOY47 | 345 |
| VOY48 | 346 |
| VOY49 | 347 |
| VOY50 | 348 |
| VOY51 | 349 |
| VOY52 | 350 |
| VOY53 | 351 |

TABLE 9-continued

| AAV Capsid Variants | |
|---|---|
| VOY ID | SEQ ID NO. |
| VOY54 | 352 |
| VOY55 | 353 |
| VOY56 | 354 |
| VOY57 | 355 |
| VOY58 | 356 |
| VOY59 | 357 |
| VOY60 | 358 |
| VOY61 | 359 |
| VOY62 | 360 |
| VOY63 | 338 |
| VOY64 | 361 |
| VOY65 | 362 |
| VOY66 | 363 |
| VOY67 | 364 |
| VOY68 | 365 |
| VOY69 | 331 |
| VOY70 | 366 |
| VOY71 | 367 |
| VOY72 | 368 |
| VOY73 | 369 |
| VOY74 | 370 |
| VOY75 | 371 |
| VOY76 | 372 |
| VOY77 | 373 |
| VOY78 | 374 |
| VOY79 | 375 |
| VOY80 | 376 |
| VOY81 | 377 |
| VOY82 | 378 |
| VOY83 | 379 |

The capsid variants of Table 9 are subjected to the method of Adachi, K. et al. (Drawing a high-resolution functional map of adeno-associated virus capsid by massively parallel sequencing. *Nat. Commun.* 5:3075 doi: 10.1038/ncomms4075 (2014); the contents of which are incorporated herein by reference in their entirety) involving a next-generation sequencing (NGS) Barcode-Seq method. Briefly, this method utilizes DNA barcode-tagged mutagenesis in conjunction with multiplexed sequencing. Results of the barcode-Seq method provide amino-acid sequence-viral capsid phenotype correlations in a high-throughput manner.

Such phenotypic correlations are then explored using one or more animal models.

In one study, non-human primates are injected intravenously with the AAV library of approximately 150 AAV strains and samples are collected during a 6-week period. Samples collected include body fluids and tissues. Barcode-Seq analysis is performed on the samples.

Multiple libraries may be subjected to the same procedure as above for phenotypic characterization. Libraries contain between 150-300 AAV strains.

Libraries may be larger or smaller, e.g., 50 strains per library.

Phenotypic analyses include but are not limited to, blood clearance rate, tissue tropism, transduction efficiency, organ or tissue targeting, reactivity to neutralizing antibodies, and AAV neutralizing antibody epitope mapping.

Organ targeting is measured for liver, heart, lung, brain, CNS tissue, kidneys, and muscle. Phenotypic responses are used to further optimize capsid designs as taught herein.

Example 7

Variable Region I (VRI) Chimeric Capsids

Figure 9:
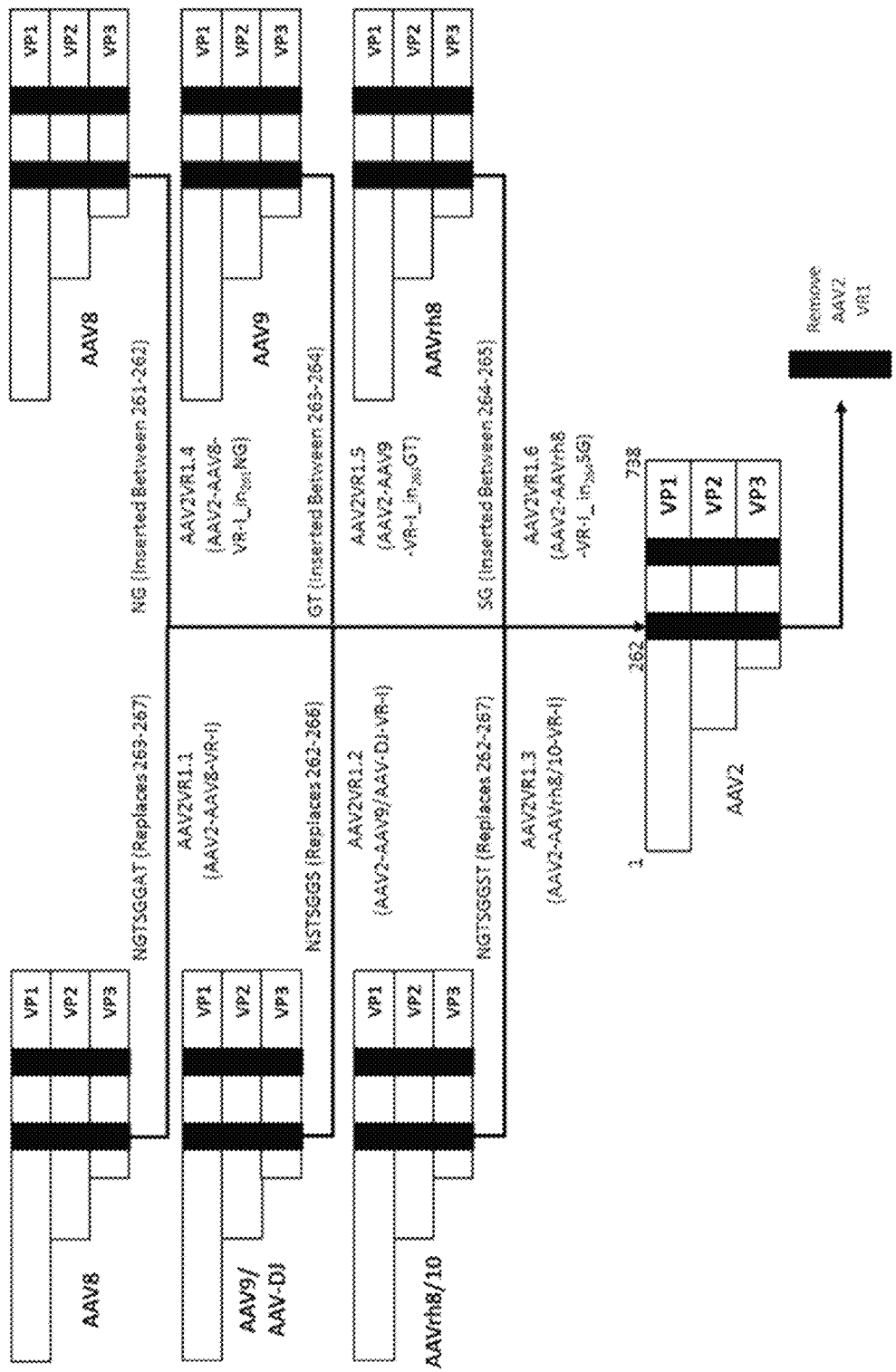
FIG. 9 is a diagram depicting the design scheme for chimeric capsid generation using sequences from AAV8, AAV9, AAV10, AAV-DJ, and AAVrh8 inserted into the VRI region of the AAV2 sequence. In this diagram the residue numbering refers to the VP1 sequence. The left group of three chimeric capsids are examples of capsid region swapping. In the top example, an 8 amino acid VR1 region of the AAV8 capsid, residues 262-269, replaces the five amino acid VR1 region (residues 263-267) of the AAV2 capsid. The right group of three chimeric capsids are examples of capsid insertions. In the top example, 2 amino acid residues from the VR1 region of the AAV8 capsid, residues 262-263, are inserted between residues 261 and 262 in the VR1 region of the AAV2 capsid.

Chimeric capsids were designed and generated using a common AAV2 sequence. Variable region I (VRI) of the AAV2 sequence was swapped with sequences from AAV8, AAV9, AAV10, AAV-DJ, or AAVrh8 VRI regions as depicted in FIG. 9. The resultant chimeric capsid nucleic acid sequences are listed in Table 10 and the encoded protein sequences in Table 11.

TABLE 10

Variable Region I (VRI) Chimeric Capsids Nucleotide Sequences

| VOY ID | SEQ ID NO. |
|---|---|
| VOY84 | 380 |
| VOY85 | 381 |
| VOY86 | 382 |
| VOY87 | 383 |
| VOY88 | 384 |
| VOY89 | 385 |

TABLE 11

Variable Region I (VRI) Chimeric Capsids Polypeptide Sequences

| VOY ID | SEQ ID NO. |
|---|---|
| VOY90 | 386 |
| VOY91 | 387 |
| VOY92 | 388 |
| VOY93 | 389 |
| VOY94 | 390 |
| VOY95 | 391 |

Example 8

Variable Region IV (VRIV) Chimeric Capsids

Figure 10:
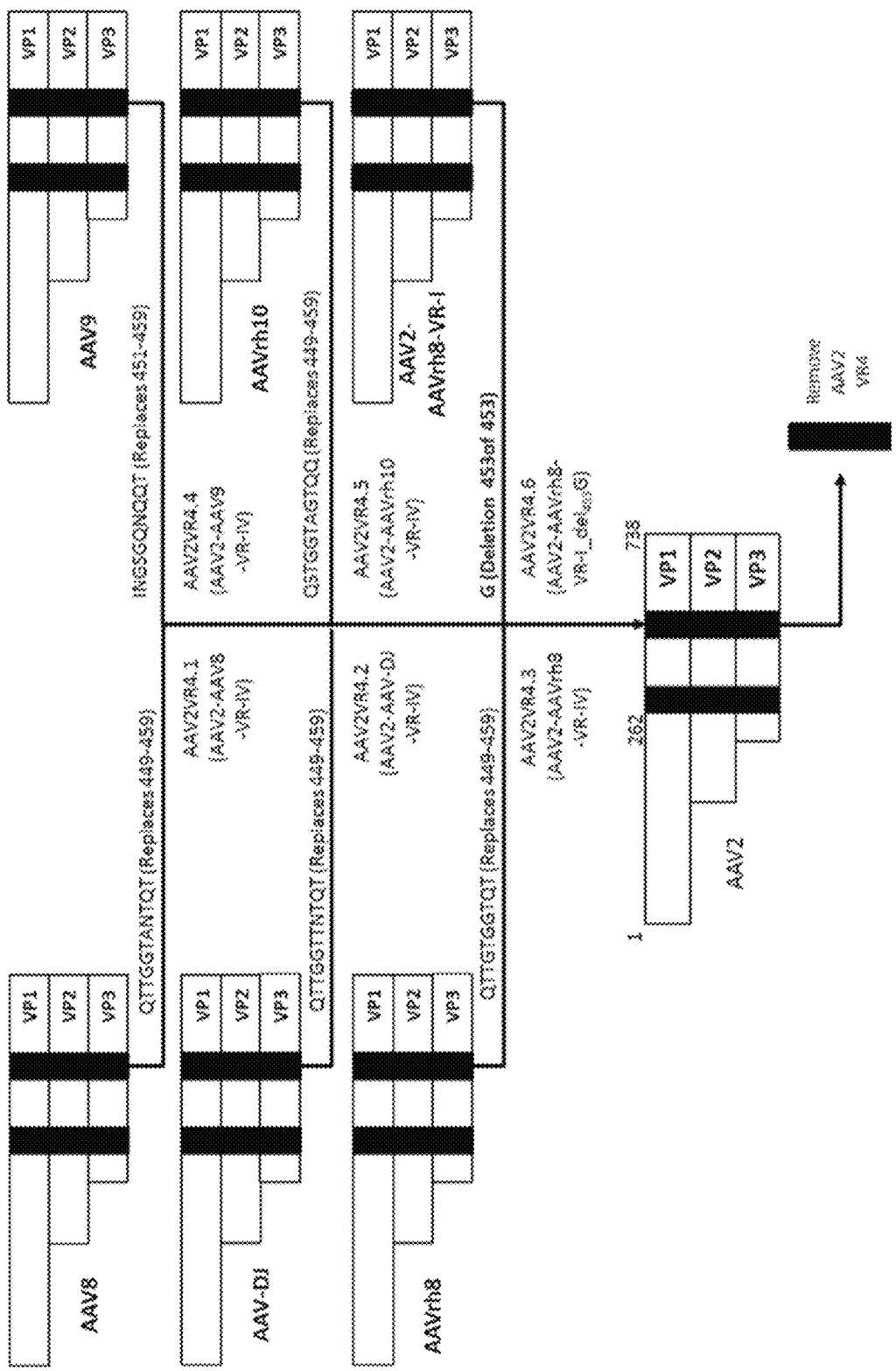
FIG. 10 is a diagram depicting the design scheme for chimeric capsid generation using sequences from AAV8, AAV9, AAVrh8, AAVrh10, and AAV-DJ, inserted into the VRIV region of the AAV2 sequence. In this diagram the residue numbering refers to the VP1 sequence. The left group of three chimeric capsids and the right top two chimeric capsids are examples of capsid swapping. In the top left example, an 11 amino acid VRIV region of the AAV8 capsid, residues 262-269, replaces the 11 amino acid VRIV region 451-459 of the AAV2 capsid. The bottom right chimeric capsid is an example of a capsid deletion. The glycine amino acid residue at position 453 in the VRIV region of the AAV2 capsid is deleted. Such deletion may impart beneficial properties to the capsid such as tropism or stability.

Chimeric capsids were generated using a common AAV2 sequence. VRIV of the AAV2 sequence was swapped with a sequence from AAV8, AAV9, AAVrh8, AAVrh10, and AAV-DJ VRIV regions as depicted in FIG. 10. The nucleic acid sequences are shown in Table 12 and the resultant chimeric capsid protein sequences are listed in Table 13.

TABLE 12

Variable Region IV (VRIV) Chimeric Capsids Nucleotide Sequences

| VOY ID | SEQ ID NO. |
|---|---|
| VOY96 | 392 |
| VOY97 | 393 |
| VOY98 | 394 |
| VOY99 | 395 |
| VOY100 | 396 |
| VOY101 | 397 |

TABLE 13

Variable Region IV (VRIV) Chimeric Capsids Polypeptide Sequences

| VOY ID | SEQ ID NO. |
|---|---|
| VOY102 | 398 |
| VOY103 | 399 |
| VOY104 | 400 |
| VOY105 | 401 |
| VOY106 | 402 |
| VOY107 | 403 |

Example 9

Additional AAV Capsid Variants

Chimeric capsids were designed based on a series of donor, e.g., parent or reference sequences from publicly available sequences. Capsid variants are engineered based on AAV capsids from viral sequences which may infect a variety of species including those listed in the table. Nucleic acid sequences are provided in Table 14.

TABLE 14

Additional AAV Capsid Variant Nucleotide Sequences

| VOY ID | SEQ ID NO. |
|---|---|
| AAVrh10 (AY243015.1) | 404 |
| AAV11 (AY631966.1) | 405 |
| AAV12 (DQ813647.1) | 406 |
| VOY108 | 407 |
| VOY109 | 408 |
| VOY110 | 409 |
| VOY111 | 186 |
| VOY112 | 410 |
| VOY113 | 162 |
| VOY114 | 411 |
| VOY115 | 412 |
| VOY116 | 413 |

TABLE 15

Additional AAV Capsid Variant Polypeptide Sequences

| VOY ID | SEQ ID NO. |
|---|---|
| AAVrh10 (AY243015.1) | 414 |
| AAV11 (AY631966.1) | 415 |
| AAV12 (DQ813647.1) | 416 |
| VOY117 | 417 |
| VOY118 | 418 |
| VOY119 | 419 |
| VOY120 | 420 |
| VOY121 | 421 |
| VOY122 | 422 |
| VOY123 | 423 |
| VOY124 | 424 |
| VOY125 | 425 |
| VOY126 | 426 |
| VOY127 | 427 |
| VOY128 | 428 |

Example 10

Central Nervous System AAV Delivery

Viral vectors are produced as taught herein and prepared for delivery to the central nervous system. In one aspect, preparation for CNS delivery is according to the method of Foust et al (Foust, K. D. et al., 2009. Nat Biotechnol 27:59-65, the contents of which are herein incorporated by reference in their entirety).

According to the Foust method, AAV9 viral vectors delivered by venous injection are transported across the blood brain barrier (BBB) and carry out astrocyte transduction. Viruses are produced and purified by cesium chloride gradient purification, followed by dialysis against phosphate buffered saline (PBS.) Resulting preparations are formulated with 0.001% Pluronic-F68 to discourage viral aggregation. Viral preparations are titrated following quantitative-PCR analysis of viral levels. Purity of viral preparations is further assessed by gel electrophoresis and subsequent silver staining (Invitrogen, Carlsbad, Calif.). Viral preparations are then delivered to subjects by intravenous injection. Viral payloads are delivered to cells of the CNS.

Example 11

AAV Polynucleotides Encoding Chimeric Capsid Proteins

Viral vectors are produced and analyzed using methods known in the art and described herein to determine if the adeno-associated viral (AAV) polynucleotide encoding a chimeric capsid protein have enhanced transduction, reduced immunogenicity, enhanced crossing the blood-brain barrier, improved expression, and/or increased expression in a baculovirus system as compared to adeno-associated viral (AAV) polynucleotides encoding a non-chimeric capsid protein.

SEQUENCE LISTING (586 sequences)

SEQ ID NO: 1 - DNA, 4718 bp, Adeno-associated virus
ttgcccactccctctctgcgcgctcgctcgctcggtggggcctgcggaccaaaggtccgcagacggcagagctctgctctgccggccccaccgagcgagcgagcgcgcagagagggagtgggcaactccatcactaggggtaatcgcgaagcgcctcccacgctgccgcgtcagcgctgacgtaaattacgtcataggggagtggtcctgtattagctgtcacgtgagtgcttttgcgacattttgcgacaccacgtggccatttagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgagctgggtggccgagaaggaatgggagctgcccccggattctgacatggatctgaatctgattgagcaggcacccctgaccgtggccgagaagctgcagcgcgacttcctggtccaatggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcctgtttgaacctggccgagcgcaaacggctcgtggcgcagcacctgacccacgtcagccagacccaggagcagaacaaggagaatctgaaccccaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcttccaactcgcggtcccagatcaaggccgctctggacaatgccggcaagatcatggcgctgaccaaatccgcgcccgactacctggtaggccccgctccgcccgcggacattaaaaccaaccgcatctaccgcatcctggagctgaacggctacgaacctgcctacgccggctccgtctttctcggctgggcccagaaaaggttcgggaagcgcaacaccatctggctgtttgggccggccaccacgggcaagaccaacatcgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggacgagagactgttcagagtgcttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaattacgtgttaatcaataaaccggttgattcgtttcagttgaactttggtctcctgtccttcttatcttatcggttaccatggttatagcttacacattaactgcttggttgcgcttcgcgataaaagacttacgtcatcgggttacccctagtgatggagttgcccactccctctctgcgcgctcgctcgctcggtggggcctgcggaccaaaggtccgcagacggcagagctctgctctgccggccccaccgagcgagcgagcgcgcagagagggagtgggcaa

SEQ ID NO: 2 - DNA, 4726 bp, Adeno-associated virus
ttggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcgcctgccgggcatttctaactcgtttgttaactgggtggccgagaaggaatgggacgtgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttgaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacgggagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtgaatcctggttaatcaataaaccgtttaattcgtttcagttgaactttggctcttgtgcacttctttatctttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggcctggcgaccaaaggtcgccagacggacgtgctttgcacgtccggccccaccgagcgagcgagtgcgcatagagggagtggccaa

SEQ ID NO: 3 - DNA, 4722 bp, Adeno-associated virus
tggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcacctgccgggcatttctaactcgtttgttaactgggtggccgagaaggaatgggagctgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttaaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacggcagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaatcctggttaatcaataaaccgtttaattcgtttcagttgaactttggctcttgtgcacttcttatcttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggccggacgtgcaaagcacgtccgtctggcgacctttggtcgccaggccccaccgagcgagcgagtgcgcatagagggagtggccaa

SEQ ID NO: 4 - DNA, 4767 bp, Adeno-associated virus
ttggccactccctctatgcgcgctcgctcactcactcggccctggagaccaaaggtctccagactgccggcctctggccggcagggccgagtgagtgagcgagcgcgcatagagggagtggccaactccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagccatgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataaatgactcaaaccagatatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataacctgttaatcaataaaccggtttattcgtttcagttgaactttggtctccgtgtccttcttatcttatctcgtttccatggctactgcgtacataagcagcggcctgcggcgcttgcgcttcgcggtttacaactgccggttaatcagtaacttctggcaaaccagatgatggagttggccacattagctatgcgcgctcgctcactcactcggccctggagaccaaaggtctccagactgccggcctctggccggcagggccgagtgagtgagcgagcgcgcatagagggagtggccaa

SEQ ID NO: 5 - DNA, 4642 bp, Adeno-associated virus
ctctcccccctgtcgcgttcgctcgctcgctggctcgtttgggggggtggcagctcaaagagctgccagacgacggccctctggccgtcgcccccccaaacgagccagcgagcgagcgaacgcgacaggggggagagtgccacactctcaagcaagggggttttgtaagcagtgatgtcataatgatgtaatgcttattgtcacgcgatagttaatgattaacagtcatgtgatgtgttttatccaataggaagaaagcgcgcgtatgagttctcgcgagacttccggggtataaaagaccgagtgaacgagcccgccgccattctttgctctggactgctagaggaccctcgctgccatggctaccttctatgaagtcattgttcgcgtcccatttgacgtggaggaacatctgcctggaatttctgacagctttgtggactgggtaactggtcaaatttgggagctgcctccagagtcagatttaaatttgactctggttgaacagcctcagttgacggtggctgatagaattcgccgcgtgttcctgtacgagtggaacaaattttccaagcaggagtccaaattctttgtgcagtttgaaaagggatctgaatattttcatctgcacacgcttgtggagacctccggcatctcttccatggtcctcggccgctacgtgagtcagattcgcgcccagctggtgaaagtggtcttccagggaattgaaccccagatcaacgactgggtcgccatcaccaaggtaaagaagggcggagccaataaggtggtggattctgggtatattcccgcctacctgctgccgaaggtccaaccggagcttcagtgggcgtggacaaacctggacgagtataaattggccgccctgaatctggaggagcgcaaacggctcgtcgcgcagtttctggcagaatcctcgcagcgctcgcaggaggcggcttcgcagcgtgagttctcggctgacccggtcatcaaaagcaagacttcccagaaatacatggcgctcgtcaactggctcgtggagcacggcatcacttccgagaagcagtggatccaggaaaatcaggagagctacctctccttcaactccaccggcaactctcggagccagatcaaggccgcgctcgacaacgcgaccaaaattatgagtctgacaaaaagcgcggtggactacctcgtggggagctccgttcccgaggacatttcaaaaaacagaatctggcaaatttttgagatgaatggctacgacccggcctacgcgggatccatcctctacggctggtgtcagcgctccttcaacaagaggaacaccgtctggctctacggacccgccacgaccggcaagaccaacatcgcggaggccatcgcccacactgtgcccttttacggctgcgtgaactggaccaatgaaaactttccctttaatgactgtgtggacaaaatgctcatttggtgggaggagggaaagatgaccaacaaggtggttgaatccgccaaggccatcctggggggctcaaaggtgcgggtcgatcagaaatgtaaatcctctgttcaaattgattctacccctgtcattgtaacttccaatacaaacatgtgtgtggtggtggatgggaattccacgacctttgaacaccagcagccgctggaggaccgcatgttcaaatttgaactgactaagcggctcccgccagattttggcaagattactaagcaggaagtcaaggacttttttgcttgggcaaaggtcaatcaggtgccggtgactcacgagtttaaagttcccagggaattggcgggaactaaaggggcggagaaatctctaaaacgcccactgggtgacgtcaccaatactagctataaaagtctggagaagcgggccaggctctcatttgttcccgagacgcctcgcagttcagacgtgactgttgatcccgctcctctgcgaccgctcaattggaattcaaggtatgattgcaaatgtgactatcatgctcaatttgacaacatttctaacaaatgtgatgaatgtgaatatttgaatcggggcaaaaatggatgtatctgtcacaatgtaactcactgtcaaatttgtcatgggattcccccctgggaaaaggaaaacttgtcagattttggggattttgacgatgccaataaagaacagtaaataaagcgagtagtcatgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaaccgtgtattcgtgtcagtaaaatactgcctcttgtggtcattcaatgaataacagcttacaacatctacaaaacctccttgcttgagagtgtggcactctcccccctgtcgcgttcgctcgctcgctggctcgtttgggggggtggcagctcaaagagctgccagacgacggccctctggccgtcgcccccccaaacgagccagcgagcgagcgaacgcgacaggggggagag

SEQ ID NO: 6 - DNA, 4404 bp, Adeno-associated virus
cgcgacaggggggagagtgccacactctcaagcaagggggttttgtaagcagtgatgtcataatgatgtaatgcttattgtcacgcgatagttaatgattaacagtcatgtgatgtgttttatccaataggaagaaagcgcgcgtatgagttctcgcgagacttccggggtataaaagaccgagtgaacgagcccgccgccattctttgctctggactgctagaggaccctcgctgccatggctaccttctatgaagtcattgttcgcgtcccatttgacgtggaggaacatctgcctggaatttctgacagctttgtggactgggtaactggtcaaatttgggagctgcctccagagtcagatttaaatttgactctggttgaacagcctcagttgacggtggctgatagaattcgccgcgtgttcctgtacgagtggaacaaattttccaagcaggagtccaaattctttgtgcagtttgaaaagggatctgaatattttcatctgcacacgcttgtggagacctccggcatctcttccatggtcctcggccgctacgtgagtcagattcgcgcccagctggtgaaagtggtcttccagggaattgaaccccagatcaacgactgggtcgccatcaccaaggtaaagaagggcggagccaataaggtggtggattctgggtatattcccgcctacctgctgccgaaggtccaaccggagcttcagtgggcgtggacaaacctggacgagtataaattggccgccctgaatctggaggagcgcaaacggctcgtcgcgcagtttctggcagaatcctcgcagcgctcgcaggaggcggcttcgcagcgtgagttctcggctgacccggtcatcaaaagcaagacttcccagaaatacatggcgctcgtcaactggctcgtggagcacggcatcacttccgagaagcagtggatccaggaaaatcaggagagctacctctccttcaactccaccggcaactctcggagccagatcaaggccgcgctcgacaacgcgaccaaaattatgagtctgacaaaaagcgcggtggactacctcgtggggagctccgttcccgaggacatttcaaaaaacagaatctggcaaatttttgagatgaatggctacgacccggcctacgcgggatccatcctctacggctggtgtcagcgctccttcaacaagaggaacaccgtctggctctacggacccgccacgaccggcaagaccaacatcgcggaggccatcgcccacactgtgcccttttacggctgcgtgaactggaccaatgaaaactttccctttaatgactgtgtggacaaaatgctcatttggtgggaggagggaaagatgaccaacaaggtggttgaatccgccaaggccatcctggggggctcaaaggtgcgggtcgatcagaaatgtaaatcctctgttcaaattgattctacccctgtcattgtaacttccaatacaaacatgtgtgtggtggtggatgggaattccacgacctttgaacaccagcagccgctggaggaccgcatgttcaaatttgaactgactaagcggctcccgccagattttggcaagattactaagcaggaagtcaaggacttttttgcttgggcaaaggtcaatcaggtgccggtgactcacgagtttaaagttcccagggaattggcgggaactaaaggggcggagaaatctctaaaacgcccactgggtgacgtcaccaatactagctataaaagtctggagaagcgggccaggctctcatttgttcccgagacgcctcgcagttcagacgtgactgttgatcccgctcctctgcgaccgctcaattggaattcaaggtatgattgcaaatgtgactatcatgctcaatttgacaacatttctaacaaatgtgatgaatgtgaatatttgaatcggggcaaaaatggatgtatctgtcacaatgtaactcactgtcaaatttgtcatgggattcccccctgggaaaaggaaaacttgtcagattttggggattttgacgatgccaataaagaacagtaaataaagcgagtagtcatgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaaccgtgtattcgtgtcagtaaaatactgcctcttgtggtcattcaatgaataacagcttacaacatctacaaaacctccttgcttgagagtgtggcactctcccccctgtcgcgcg

SEQ ID NO: 7 - DNA, 4636 bp, Adeno-associated virus
ctctcccccctgtcgcgttcgctcgctcgctggctcgtttgggggggtggcagctcaaagagctgccagacgacggccctctggccgtcgcccccccaaacgagccagcgagcgagcgaacgcgacaggggggagagtgccacactctcaagcaaggaggttttgtaagtggtgatgtcatatagttgtcacgcgatagttaatgattaacagtcaggtgatgtgtgttatccaataggatgaaagcgcgcgcatgagttctcgcgagacttccggggtataaaggggtgagtgaacgagcccgccgccattctctgctctgaactgctagaggaccctcgctgccatggctaccttctacgaagtcattgttcgcgtcccatttgacgtggaggaacatctgcctggaatttctgacagctttgtggactgggtaactggtcaaatttgggagctgcctcccgagtcagatttgaatttgactctgattgagcagcctcagctgacggttgctgacagaattcgccgcgtgttcctgtacgagtggaacaaattttccaagcaggaatccaaattctttgtgcagtttgaaaagggatctgaatattttcatctgcacacgcttgtggagacctccggcatctcttccatggtcctaggccgctacgtgagtcagattcgcgcccagctggtgaaagtggtcttccagggaatcgagccacagatcaacgactgggtcgccatcaccaaggtaaagaagggcggagccaataaggtggtggattctgggtatattcccgcctacctgctgccgaaggtccaaccggagcttcagtgggcgtggacaaacctggacgagtataaattggccgccctgaacctggaggagcgcaaacggctcgtcgcgcagtttctggcagaatcctcgcagcgctcgcaggaggcggcttcgcagcgtgagttctcggctgacccggtcatcaaaagcaagacttcccagaaatacatggcgctcgtcaactggctcgtggagcacggcatcacttccgagaagcagtggatccaggagaatcaggagagctacctctccttcaactccacgggcaactctcggagccaaatcaaggccgcgctcgacaacgcgaccaaaatcatgagtctgacaaaaagcgcggtggactacctcgtggggagctccgttcccgaggacatttcaaaaaacagaatctggcaaatttttgagatgaacggctacgacccggcctacgcgggatccatcctctacggctggtgtcagcgctccttcaacaagaggaacaccgtctggctctacggacccgccacgaccggcaagaccaacatcgcggaggccatcgcccacactgtgcccttttacggctgcgtgaactggaccaatgaaaactttccctttaatgactgtgtggacaaaatgctcatttggtgggaggagggaaagatgaccaacaaggtggttgaatccgccaaggccatcctggggggctccaaggtgcgggtcgatcagaaatgtaaatcctctgttcaaattgattctacccccgtcattgtaacttccaatacaaacatgtgtgtggtggtggatgggaattccacgacctttgaacaccagcagccgctggaggaccgcatgttcaaatttgaactgactaagcggctcccgccagattttggcaagattactaagcaggaagtcaaagacttttttgcttgggcaaaggtcaatcaggtgccggtgactcacgagtttaaagttcccagggaattggcgggaactaaaggggcggagaaatctctaaaacgcccactgggtgacgtcaccaatactagctataaaagtccagagaagcgggcccggctctcatttgttcccgagacgcctcgcagttcagacgtgactgtcgatcccgctcctctgcgaccgctcaattggaattcaaggtatgattgcaaatgtgaccatcatgctcaatttgacaacatttctgacaaatgtgatgaatgtgaatatttgaatcggggcaaaaatggatgtatctgtcacaatgtaactcactgtcaaatttgtcacgggattcccccctgggagaaggaaaacttgtcagattttggggattttgacgatgccaataaagaacagtaaataaagcgagtagtcatgtcttttgttgatcaccctccagattggttggaagaagttggtgaaggtcttcgcgagtttttgggccttgaagcgggcccaccgaaaccgaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcacaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgcacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactattggggcttcagaccccggtctctcagagtcaaaatcttcaacatccaagtcaaagaggtcacggtgcaggactccaccaccaccatcgccaacaacctcacctccaccgtccaagtgtttacggacgacgactaccaactcccgtacgtcgtcggcaacgggaccgagggatgcctgccggccttccccccgcaggtctttacgctgccgcagtacggctacgcgacgctgaaccgagacaacggagacaacccgacagagcggagcagcttcttttgcctagagtactttcccagcaagatgctgaggacgggcaacaactttgagtttacctacagctttgaagaggtgcccttccactgcagcttcgccccgagccagaacctctttaagctggccaacccgctggtggaccagtacctgtaccgcttcgtgagcacctcggccacgggcgccatccagttccaaaagaacctggcgggcagatacgccaacacctacaaaaactggttcccggggcccatgggccgaacccagggctggaacacgagctctggcagcagcaccaacagagtcagcgtcaacaacttttccgtctcaaaccggatgaacctggagggggccagctaccaagtgaacccccagcccaacgggatgacaaacacgctccaaggcagcaaccgctacgcgctggaaaacaccatgatcttcaacgctcaaaacgccacgccgggaactacctcggtgtacccagaggacaatctactgctgaccagcgagagcgagactcagcccgtcaaccgggtggcttacaacacgggcggtcagatggccaccaacgcccagaacgccaccacggctcccacggtcgggacctacaacctccaggaagtgcttcctggcagcgtatggatggagagggacgtgtacctccaaggacccatctgggccaagatcccagagacgggggcgcactttcacccctctccggccatgggcggattcggactcaaacacccgccgcccatgatgctcatcaaaaacacgccggtgcccggcaacatcaccagcttctcggacgtgcccgtcagcagcttcatcacccagtacagcaccgggcaggtcaccgtggagatggaatgggagctcaaaaaggaaaactccaagaggtggaacccagagatccagtacaccaacaactacaacgacccccagtttgtggactttgctccagacggctccggcgaatacagaaccaccagagccatcggaacccgatacctcacccgacccctttaacccattcatgtcgcataccctcaataaaccgtgtattcgtgtcagtgaaatactgcctcttgtggtcattcaatgaacatcagcttacaacatctacaaaacccccttgcttgagagtgtggcactctcccccctgtcgcgttcgctcgctcgctggctcgtttgggggggtggcagctcaaagagctgccagacgacggccctctggccgtcgcccccccaaacgagccagcgagcgagcgaacgcgacaggggggagag

SEQ ID NO: 8 - DNA, 4683 bp, Adeno-associated virus
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagcgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgacttcctggtccagtggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcgtgtttaaacctggccgagcgcaaacggctcgtggcgcacgacctgacccacgtcagccagacccaggagcagaacaaggagaatctgaaccccaattctgacgcgcctgtcatccggtcaaaaacctccgcacgctacatggagctggtcgggtggctggtggaccggggcatcacctccgagaagcagtggatccaggaggaccaggcctcgtacatctccttcaacgccgcctccaactcgcggtcccagatcaaggccgctctggacaatgccggcaagatcatggcgctgaccaaatccgcgcccgactacctggtaggccccgctccgcccgccgacattaaaaccaaccgcatttaccgcatcctggagctgaacggctacgaccctgcctacgccggctccgtctttctcggctgggcccagaaaaggttcggaaaacgcaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggatctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttaattcgtgtcagttgaactttggtctcatgtcgttattatcttatctggtcaccatagcaaccggttacacattaactgcttagttgcgcttcgcgaatacccctagtgatggagttgcccactccctctatgcgcgctcgctcgctcggtggggccggcagagcagagctctgccgtctgcggacctttggtccgcaggccccaccgagcgagcgagcgcgcatagagggagtgggcaa

SEQ ID NO: 9 - DNA, 4721 bp, Adeno-associated virus
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccgcgaagcgcctcccacgctgccgcgtcagcgctgacgtaaatcacgtcataggggagtggtcctgtattagctgtcacgtgagtgcttttgcgacattttgcgacaccacgtggccatttgaggtatatatggccgagtgagcgagcaggatctccattttgaccgcgaaatttgaacgagcagcagccatgccgggtttctacgagatcgtgatcaaggtgccgagcgacctggacgagcacctgccgggcatttctgactcgtttgtgaactgggtggccgagaaggaatgggagctgcccccggattctgacatggatctgaatctgatcgagcaggcacccctgaccgtggccgagaagctgcagcgcgacttcctggtccaatggcgccgcgtgagtaaggccccggaggccctgttctttgttcagttcgagaagggcgagagctacttccaccttcacgttctggtggagaccacgggggtcaagtccatggtgctaggccgcttcctgagtcagattcgggagaagctggtccagaccatctaccgcggggtcgagcccacgctgcccaactggttcgcggtgaccaagacgcgtaatggcgccggcggggggaacaaggtggtggacgagtgctacatccccaactacctcctgcccaagacccagcccgagctgcagtgggcgtggactaacatggaggagtatataagcgcgtgtttgaacctggccgaacgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattaaaaccaaccgcatctaccgcatcctggagctgaacgggtacgatcctgcctacgccggctccgtctttctcggctgggcccagaaaaagttcgggaagcgcaacaccatctggctgtttgggcccgccaccaccggcaagaccaacattgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcacgactttggcaaggtgacgaagcaggaagtcaaagagttcttccgctgggccagtgatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgattcagatgctgtttccctgcaaaacgtgcgagagaatgaatcagaatttcaacatttgcttcacacacggggtcagagactgtttagagtgtttccccggcgtgtcagaatctcaaccggtcgtcagaaaaaagacgtatcggaaactctgcgcgattcatcatctgctggggcgggcgcccgagattgcttgctcggcctgcgacctggtcaacgtggacctggacgactgcgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaattgcatgttaatcaataaaccggttgattcgtttcagttgaactttggtctcctgtgcttcttatcttatcggtttccatagcaactggttacacattaactgcttgggtgcgcttcacgataagaacactgacgtcaccgcggtacccctagtgatggagttggccactccctctatgcgcgctcgctcgctcggtggggcctgcggaccaaaggtccgcagacggcagagctctgctctgccggccccaccgagcgagcgagcgcgcatagagggagtggccaa

SEQ ID NO: 10 - DNA, 4393 bp, Adeno-associated virus
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacaccacgtggccatttgaggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggaaaagcttggtccagaccatctacccgcggggtcgagccccaccttgcccaactggttcgcggtgaccaaagacgcggtaatggcgccggcgggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctatatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattacccagaaccgcatctaccgcatcctcgctctcaacggctacgaccctgcctacgccggctccgtctttctcggctgggctcagaaaaagttcgggaaacgcaacaccatctggctgtttggacccgccaccaccggcaagaccaacattgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcg

SEQ ID NO: 11 - DNA, 4385 bp, Adeno-associated virus
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacggcaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccaaaggtgtttactctgagcctcgccccattggtactcgttacctcacccgtaatttgtaattgcctgttaatcaataaaccggttaattcgtttcagttgaactttggtctctgcg

SEQ ID NO: 12 - DNA, 4102 bp, Adeno-associated virus
atgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccactggcgccgcgtgagtaaggccccggaggccctcttctttgttcagttcgagaagggcgagtcctactttcacctgcacgttctggtcgagaccacgggggtcaagtccatggtcctgggccgcttcctgagtcagatcagagacaggctggtgcagaccatctaccgcggggtagagcccacgctgcccaactggttcgcggtgaccaagacgcgaaatggcgccggcggggggaacaaggtggtggacgagtgctacatccccaactacctcctgcccaagacgcagcccgagctgcagtgggcgtggactaacatggaggagtatataagcgcgtgtctgaacctcgcggagcgtaaacggctcgtggcgcagcacctgacccacgtcagccagacgcaggagcagaacaaggagaatctgaacccgaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggaaagatcatggcgctgaccaaatccgcgcccgactacctggtaggcccgtccttacccgcggacattaaggccaaccgcatctaccgcatcctggagctcaacggctacgaccccgcctacgccggctccgtcttcctgggctgggcgcagaaaaagttcggtaaaaggaatacaatttggctgttcgggcccgccaccaccggcaagaccaacatcgcggaagccatcgcccacgccgtgcccttctacggctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtcgaccaaaagtgcaagtcctcggcccagatcgaccccacgcccgtgatcgtcacctccaacaccaacatgtgcgccgtgatcgacgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtgacgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacctgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttgggcagactggcgagtcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatctccaacgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggatgtcttcatgattccccagtacggctacctgacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcattgaccagtacctgtactacttatccagaactcagtccacaggaggaactcaaggtacccagcaattgttattttctcaagctgggcctgcaaacatgtcggctcaggccaagaactggctgcctggaccttgctaccggcagcagcgagtctccacgacactgtcgcaaaacaacaacagcaactttgcttggactggtgccaccaaatatcacctgaacggaagagactctctggtgaatcccggtgtcgccatggcaacccacaaggacgacgaggaacgcttcttcccgtcgagcggagtcctgatgtttggaaaacagggtgctggaagagacaatgtggactacagcagcgttatgctaacaagcgaagaagaaattaaaaccactaaccctgtagccacagaacaatacggcgtggtggctgacaacttgcagcaagccaatacagggcctattgtgggaaatgtcaacagccaaggagccttacctggcatggtctggcagaaccgagacgtgtacctgcagggtcccatctgggccaagattcctcacacggacggcaactttcacccgtctcctctgatgggcggctttggacttaaacacccgcctccacagatcctgatcaagaacacgccggtacctgcggatcctccaacaacgttcagccaggcgaaattggcttccttcatcacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttatctgacacgtaatctgtaa

SEQ ID NO: 13 - DNA, 4087 bp, Adeno-associated virus
atgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccactggcgccgcgtgagtaaggccccggaggccctcttctttgttcagttcgagaagggcgagtcctacttccacctccacgttctcgtcgagaccacgggggtcaagtccatggtcctgggccgcttcctgagtcagatcagagacaggctggtgcagaccatctaccgcggggtcgagcccacgctgcccaactggttcgcggtgaccaagacgcgaaatggcgccggcggggggaacaaggtggtggacgagtgctacatccccaactacctcctgcccaagacccagcccgagctgcagtgggcgtggactaacatggaggagtatataagcgcgtgtctaaacctcgcggagcgtaaacggctcgtggcgcagcacctgacccacgtcagccagacgcaggagcagaacaaggagaatctgaacccgaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggaaagatcatggcgctgaccaaatccgcgcccgactacctggtaggcccgtccttacccgcggacattaaggccaaccgcatctaccgcatcctggagctcaacggctacgaccccgcctacgccggctccgtcttcctgggctgggcgcagaaaaagttcggtaaacgcaacaccatctggctgtttgggcccgccaccaccggcaagaccaacatcgcggaagccatagcccacgccgtgcccttctacggctgcgtgaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcctcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttccggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagccccgaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaaaacggctcctggaaagaagagaccgttagagtcaccacaagagcccgactcctcctcgggcatcggcaaaaaaggcaaacaaccagccagaaagaggctcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcgtctcggaacaacatcaagcagcaacacctacaacggattctccaccccctggggatattttgacttcaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagaggggagcctgcctcctttccccaatgacgtgttcatggtgcctcaatatggctactgtggcatcgtgactggcgagaatcagaaccaaacggacagaaacgctttctactgcctggagtattttccttcgcaaatgttgagaactggcaacaactttgaaatggcttacaactttgagaaggtgccgttccactcaatgtatgctcacagccagagcctggacagactgatgaatcccctcctggaccagtacctgtggcacttacagtcgactacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatcgcgcccggacctccaatggccacagccggaccttcggatggggacttcagtaacgcccagcttatattccctggaccatctgttaccggaaatacaacaacttcagccaacaatctgttgtttacatcagaagaagaaattgctgccaccaacccaagagacacggacatgtttggccagattgctgacaataatcagaatgctacaactgctcccataaccggcaacgtgactgctatgggagtgctgcctggcatggtgtggcaaaacagagacatttactaccaagggccaatttgggccaagatcccacacgcggacggacattttcatccttcaccgctgattggtgggtttggactgaaacacccgcctccccagatattcatcaagaacactcccgtacctgccaatcctgcgacaaccttcactgcagccagagtggactctttcatcacacaatacagcaccggccaggtcgctgttcagattgaatgggaaattgaaaaggaacgctccaaacgctggaatcctgaagtgcagtttacttcaaactatgggaaccagtcttctatgttgtgggctcctgatacaactgggaagtatacagagccgcgggttattggctctcgttatttgactaatcatttgtaa

SEQ ID NO: 14 - DNA, 4213 bp, Adeno-associated virus
ttgcgacagtttgcgacaccatgtggtcacaagaggtatataaccgcgagtgagccagcgaggagctccattttgcccgcgaagtttgaacgagcagcagccatgccggggttctacgaggtggtgatcaaggtgcccagcgacctggacgagcacctgcccggcatttctgactcctttgtgaactgggtggccgagaaggaatgggagttgcccccggattctgacatggatcagaatctgattgagcaggcacccctgaccgtggccgagaagctgcagcgcgagttcctggtggaatggcgccgagtgagtaaatttctggaggccaagttttttgtgcagtttgaaaagggggactcgtactttcatttgcatattctgattgaaattaccggcgtgaaatccatggtggtgggccgctacgtgagtcagattagggataaactgatccagcgcatctaccgcggggtcgagccccagctgcccaactggttcgcggtcacaaagacccgaaatggcgccggaggcgggaacaaggtggtggacgagtgctacatccccaactacctgctccccaaggtccagcccgagcttcagtgggcgtggactaacatggaggagtatataagcgcctgtttgaacctcgcggagcgtaaacggctcgtggcgcagcacctgacgcacgtctcccagacccaggagggcgacaaggagaatctgaacccgaattctgacgcgccggtgatccggtcaaaaacctccgccaggtacatggagctggtcgggtggctggtggacaagggcatcacgtccgagaagcagtggatccaggaggaccaggcctcgtacatctccttcaacgcggcctccaactcccggtcgcagatcaaggcggccctggacaatgcctccaaaatcatgagcctcaccaaaacggctccggactatctcatcgggcagcagcccgtgggggacattaccaccaaccggatctacaaaatcctggaactgaacgggtacgacccccagtacgccgcctccgtctttctcggctgggcccagaaaaagtttggaaagcgcaacaccatctggctgtttgggcccgccaccaccggcaagaccaacatcgcggaagccatcgcccacgcggtccccttctacggctgcgtcaactggaccaatgagaactttcccttcaacgactgcgtcgacaaaatggtgatttggtgggaggagggcaagatgaccgccaaggtcgtagagtccgccaaggccattctgggcggcagcaaggtgcgcgtggaccaaaaatgcaaggcctctgcgcagatcgaccccacccccgtgatcgtcacctccaacaccaacatgtgcgccgtgattgacgggaacagcaccaccttcgagcaccagcagcccctgcaggaccggatgttcaagtttgaactcacccgccgcctcgaccacgactttggcaaggtcaccaagcaggaagtcaaggactttttccggtgggcggctgatcacgtgactgacgtggctcatgagttttacgtcacaaagggtggagctaagaaaaggcccgccccctctgacgaggatataagcgagcccaagcggccgcgcgtgtcatttgcgcagccggagacgtcagacgcggaagctcccggagacttcgccgacaggtaccaaaacaaatgttctcgtcacgcgggtatgctgcagatgctctttccctgcaagacgtgcgagagaatgaatcagaattccaacgtctgcttcacgcacggtcagaaagattgcggggagtgctttcccgggtcagaatctcaaccggtttctgtcgtcagaaaaacgtatcagaaactgtgcatccttcatcagctccggggggcacccgagatcgcctgctctgcttgcgaccaactcaaccccgatttggacgattgccaatttgagcaataaatgactgaaatcaggtatggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgcccattagaaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatgcgtgcggcgccaggcggaaatgctgtcgaggcgggacaaggtgccgatggagtgggtaatgcctccggtgattggcattgcgattccacctggtcagagggccgagtcaccaccaccagcacccgaacctgggtcctacccacgtacaacaaccacctgtacctgcgaatcggaacaacggccaacagcaacacctacaacggattctccaccccctggggatactttgactttaaccgcttccactgccacttttccccacgcgactggcagcgactcatcaacaacaactggggactcaggccgaaatcgatgcgtgttaaaatcttcaacatacaggtcaaggaggtcacgacgtcaaacggcgagactacggtcgctaataaccttaccagcacggttcagatctttgcggattcgacgtatgaactcccatacgtgatggacgccggtcaggaggggagctttcctccgtttcccaacgacgtctttatggttccccaatacggatactgcggagttgtcactggaaaaaaccagaaccagacagacagaaatgccttttactgcctggaatactttccatcccaaatgctaagaactggcaacaattttgaagtcagttaccaatttgaaaaagttcctttccattcaatgtacgcgcacagccagagcctggacagaatgatgaatcctttactggatcagtacctgtggcatctgcaatcgaccactaccggaaattcccttaatcaaggaacagctaccaccacgtacgggaaaattaccactggagactttgcctactacaggaaaaactggttgcctggagcctgcattaaacaacaaaaattttcaaagaatgccaatcaaaactacaagattcccgccagcgggggagacgcccttttaaagtatgacacgcataccactctaaatgggcgatggagtaacatggctcctggacctccaatggcaaccgcaggtgccggggactcggattttagcaacagccagctgatctttgccggacccaatccgagcggtaacacgaccacatcttcaaacaatttgttgtttacctcagaagaggagattgccacaacaaacccacgagacacggacatgtttggacagattgcagataataatcaaaatgccaccaccgcccctcacatcgctaacctggacgctatgggaattgttcccggaatggtctggcaaaacagagacatctactaccagggccctatttgggccaaggtccctcacacggacggacactttcacccttcgccgctgatgggaggatttggactgaaacacccgcctccacagattttcatcaaaaacacccccgtacccgccaatcccaatactacctttagcgctgcaaggattaattcttttctgacgcagtacagcaccggacaagttgccgttcagatcgactgggaaattcagaaggagcattccaaacgctggaatcccgaagttcaatttacttcaaactacggcactcaaaattctatgctgtgggctcccgacaatgctggcaactaccacgaactccgggctattgggtcccgtttcctcacccaccacttgtaa

SEQ ID NO: 15 - DNA, 4180 bp, Adeno-associated virus
ccgcgagtgagcgaaccaggagctccattttgcccgcgaattttgaacgagcagcagccatgccgggattctacgagattgtcctgaaggtgcccagcgacctggacgagcacctgcctggcatttctgactcttttgtaaactgggtggcggagaaggaatgggagctgccgccggattctgacatggatctgaatctgattgagcaggcacccctaaccgtggccgaaaagctgcaacgcgaattcctggtcgagtggcgccgcgtgagtaaggccccggaggccctcttctttgttcagttcgagaagggggacagctacttccacctacacattctggtggagaccgtgggcgtgaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaatatggaccagtatttaagcgcctgtttgaatctcgcggagcgtaaacggctggtggcgcagcatctgacgcacgtgtcgcagacgcaggagcagaacaaagagaaccagaatcccaattctgacgcgccggtgatcagatcaaaaacctccgcgaggtacatggagctggtcgggtggctggtggaccgcgggatcacgtcagaaaagcaatggatccaggaggaccaggcctcttacatctccttcaacgccgcctccaactcgcggtcacaaatcaaggccgcactggacaatgcctccaaatttatgagcctgacaaaaacggctccggactacctggtgggaaacaacccgccggaggacattaccagcaaccggatctacaaaatcctcgagatgaacgggtacgatccgcagtacgcggcctccgtcttcctgggctgggcgcaaaagaagttcgggaagaggaacaccatctggctctttgggccggccacgacgggtaaaaccaacatcgctgaagctatcgcccacgccgtgcccttttacggctgcgtgaactggaccaatgagaactttccgttcaacgattgcgtcgacaagatggtgatctggtgggaggagggcaagatgacggccaaggtcgtggagtccgccaaggccattctgggcggaagcaaggtgcgcgtggaccaaaagtgcaagtcatcggcccagatcgacccaactcccgtcatcgtcacctccaacaccaacatgtgcgcggtcatcgacggaaattccaccaccttcgagcaccaacaaccactccaagaccggatgttcaagttcgagctcaccaagcgcctggagcacgactttggcaaggtcaccaagcaggaagtcaaggactttttccggtgggcgtcagatcacgtgactgaggtgtctcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggcatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacatatcagaaactgtgtccgattcatcacatcatggggagggcgcccgaggtggcttgttcggcctgcgatctggccaatgtggacttggatgactgtgacatggagcaataaatgactcaaaccagatatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggacttgacaagggggaacccgtcaacgcagcggacgcggcagccctcgaacacgacaaggcctacgaccagcagctcaaggccggtgacaacccctacctcaagtacaaccacgccgacgccgagtttcaggagcgtcttcaagaagatacgtcttttgggggcaacctcggacgagcagtcttccaggccaaaaagaggatccttgagcctctgggtctggttgaggaagcggctaagacggctcctggaaaaaagagacctgtagagcaatctccagcagaaccggactcctcttcgggcatcggcaaatcaggccagcagcccgctagaaaaagactgaattttggtcagactggcgacacagagtcagtcccagaccctcaaccactcggacaacctcccgcagccccctctggtgtgggatctactacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccctgcccacctacaacaatcacctctacaagcaaatctccagccaatcaggagccaccaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactccgagtaccagctcccgtacgtcctcggctcggcgcatcagggatgcctcccgccgttcccagcagacgtcttcatggtcccacagtatggatacctcaccctgaacaacgggagtcaggcggtaggacgctcttccttttactgcctggagtactttccttctcagatgctgcgtactggaaacaactttcagtttagctacacttttgaagacgtgcctttccacagcagctacgctcacagccaaagtctggaccgtctcatgaatcctctgatcgaccagtacctgtactatctgaacaggacacaaacagccagtggaactcagcagtctcggctactgtttagccaagctggacccaccagtatgtctcttcaagctaaaaactggctgcctggaccttgctacagacagcagcgtctgtcaaagcaggcaaacgacaacaacaacagcaactttccctggactggtgccaccaaatatcatctgaatggccgggactcattggtgaacccgggccctgctatggccagtcacaaggatgacaaagaaaagtttttccccatgcatggaaccctgatatttggtaaagaaggaacaaatgccaacaacgcggatttggaaaatgtcatgattacagatgaagaagaaatccgcaccaccaatcccgtggctacggagcagtacgggactgtgtcaaataatttgcaaaactcaaacgctggtccaactactggaactgtcaatcaccaaggagcgttacctggtatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaactttagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccggttaattcg

SEQ ID NO: 16 - DNA, 4679 bp, Adeno-associated virus
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 17 - DNA, 145 bp, Adeno-associated virus
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcct

SEQ ID NO: 18 - protein, 536 aa, Adeno-associated virus
MPGFYEIVIKVPSDLDEHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRLARGHSL

SEQ ID NO: 19 - protein, 621 aa, Adeno-associated virus
MPGFYEIVIKVPSDLDEHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 20 - protein, 312 aa, Adeno-associated virus
MELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRLARGHSL

SEQ ID NO: 21 - protein, 397 aa, Adeno-associated virus
MELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 22 - protein, 735 aa, Adeno-associated virus [sequence omitted]

SEQ ID NO: 23 - protein, 598 aa, Adeno-associated virus
MAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 24 - protein, 533 aa, Adeno-associated virus
MATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 25 - protein, 204 aa, Adeno-associated virus
METQTQYLTPSLSDSHQQPPLVWELIRWLQAVAHQWQTITRAPTEWVIPREIGIAIPHGWATESSPPAPEPGPCPPTTTTSTNKFPANQEPRTTITTLATAPLGGILTSTDSTATFHHVTGKDSSTTTGDSDPRDSTSSSLTFKSKRSRRMTVRRRLPITLPARFRCLLTRSTSSRTSSARRIKDASRRSQQTSSWCHSMDTSP

SEQ ID NO: 26 - DNA, 145 bp, Adeno-associated virus
aggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 27 - DNA, 4675 bp, Adeno-associated virus
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgtacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccggccatggcaagccacaaggacgatgaagaaaagttttttcctcagagcggggttctcatctttgggaagcaaggctcagagaaaacaaatgtgaacattgaaaaggtcatgattacagacgaagaggaaatcggaacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacacggtcagcgtggagatcgagtgggagctgcagaaggaaaacagcaaacgctggaatcccgaaattcagtacacttccaactacaacaagtctgttaatcgtggacttaccgtggatactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 28 - protein, 536 aa, Adeno-associated virus
MPGFYEIVIKVPSDLDGHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRLARGHSL

SEQ ID NO: 29 - protein, 621 aa, Adeno-associated virus
MPGFYEIVIKVPSDLDGHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 30 - protein, 504 aa, Adeno-associated virus
MATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPAMASHKDDEEKFFPQSGVLIFGKQGSEKTNVNIEKVMITDEEEIGTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGHGQRGDRVGAAEGKQQTLESRNSVHFQLQQVC

SEQ ID NO: 31 - DNA, 4429 bp, Adeno-associated virus
ctccatcactaggggttcctggaggggtggagtcgtgacgtgaattacgtcatagggttagggaggtcctgtattagaggtcacgtgagtgttttgcgacattttgcgacaccatgtggttacgcagggtatataagcccgagtgagcacgcagggtctccattttgaagcgggaggtttgaacgcgcagccgccatgccgggattttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggagtggcgccgtgtgagtaaggccccggaggctcttttctttgtgcaatttgagaagggagagagctacttccacatgcacgtgctggtggagaccaccggggtgaaatccatggttttgggacgtttcctgagtcagattcgcgaaaaactgattcagagaatttaccgcgggatcgagccgactttgccaaactggttcgcggtcacaaagacccgaaatggcgccggaggcgggaacaaggtggtggatgagtgctacatccccaattacctgctccccaaaacccagcctgagctccagtgggcgtggactaatatggaacagtatttaagcgcctgtttgaatctcgcggagcgtaaacggttggtggcgcagcatctgacgcacgtgtcgcagacgcaggagcagaacaaagagaatcagaatcccaattctgacgcgccggtgattagatcaaaaacctcagccaggtacatggagctggtcgggtggctcgtggataaggggattacctcggagaagcagtggatccaggaggatcaggcttcatacatctcctttaatgcggcctccaactcgcggtcccagattaaggctgctctggacaatgcgggaaaaatcatgagcctcactaaaactgcccccgactacctggtgggccagcagcccgtggaggacatttccagcaatcggatttataaaatcttggaactgaacgggtacgacccccaatacgcggcttccgtcttcctgggatgggccacgaaaaagttcggcaagaggaacaccatctggctgtttgggcctgcaactaccggaaagaccaacatcgcggaggctatagcccacactgtgcctttttacgggtgcgtaaactggaccaatgagaactttcctttcaacgactgtgtcgacaagatggtgatctggtgggaggagggaaagatgaccgccaaggtcgtggagtcggccaaagccattctcggcggaagcaaggtgcgcgtggaccagaaatgcaagtcctcggcccagatagacccgactcccgtgatcgtcacctccaacaccaacatgtgcgccgtgattgacgggaactcaacgaccttcgagcaccagcagccgttgcaagaccggatgttcaaatttgaactcacccgccgtctggatcatgactttgggaaggtcacaaagcaggaagtcaaagactttttccggtgggcaaaggatcacgtggtagaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcagacaggtaccaaaacaaatgttctcgtcacgtgggcatgaatctgatgctgtttccctgcagacagtgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtaccagacgcttgcactgcctgcaacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggagcctgttaagacggctccgggaaaaaagaggccggtagagcactctcctgcggagccagattcctcctccggaactggaaagtcgggccaacagcctgcaagaaagagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccatctgtacaagcagatttccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgctgcgtactggaaacaactttaccttcagctacacctttgaagacgttcctttccacagcagctacgctcacagccaaagtctggaccgtctcatgaatcctctcatcgaccagtacctgtattacttgagcagaacaaacacgccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaattttttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttcctggcatggtctggcaggacagagacgtgtacctgcaggggcccatttgggcaaagattccccacacggatggacacttttacccttctcctcttatgggaggatttggactgaagcaccctcccccgcagattctcatcaagaataccccggtacctgcaaatccttcgaccaccttcagtgcggcaaagtttgcttctttcatcacacagtactccacggggcaggtcagcgtggagatagagtgggagctgcagaaggagaacagcaaacgctggaatcccgagatccagtatacttccaactataacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgtacttctttcttatctagtttccatggctacgtagataagtgccatggcgggtgaatcattaaccaaaaggaacccctagtgatggag

SEQ ID NO: 32 - DNA, 4429 bp, Adeno-associated virus
ctccatcactaggggttcctggaggggtggagtcgtgacgtgaattacgtcatagggttagggaggtcctgtattagaggtcacgtgagtgttttgcgacattttgcgacaccatgtggttacgctgggtatttaagcccgagtgagcacgcagggtctccattttgaagcgggaggtttgaacgcgcagccgccatgccggggttttacgagattgtgattaaggtccccagcgaccttgacgagcatttgcccggcatttctgacagctttgtgaactgggtggccgagaaggaatgggagttgccgccagattctgacatggatctgaatctgattgagcaggcacccctgaccgtggccgagaagctgcagcgcgactttctgacggagtggcgccgcgtgagtaaggccccggaggccctcttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaacggcgccggaggcgggaacaaggtggtggatgagtgctacatccccaattacctgctccccaaaacccagcctgagctccagtgggcgtggactaatatggaacagtatttaagcgcctgtttgaatctcgcggagcgtaaacggttggtggcgcagcatctgacgcacgtgtcgcagacgcaggagcagaacaaagagaatcagaatcccaattctgacgcgccggtgattagatcaaaaacctcagccaggtacatggagctggtcgggtggctcgtggataaggggattacctcggagaagcagtggatccaggaggaccaggcctcatacatctccttcaatgcggcctccaactcgcggtcccagatcaaggctgctctggacaatgcggggaagatcatgagcctgactaaaaccgcccccgactacctggtgggccagcagcccgtggaggacatttccagcaatcggatttataaaatcttggaactgaacgggtacgatccccaatacgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggactaatgagaactttcccttcaacgactgtgtcgacaagatggtgatctggtgggaggaggggaagatgaccgccaaggtcgtggagtcggccaaagctattctcggcggaagcaaggtgcgcgtggaccagaaatgcaagtcctcggcccagatagacccgactcccgtgatcgtcacctccaacaccaacatgtgcgccgtgattgacgggaactcaacgaccttcgagcaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggcgcgcgagtcagttgcgcagccatcgacgtcagacgcggaagcttcaatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtaccagacgcttgcactgcctgcaacctggtcaatgtggatttagatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcacaaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaaaacggctccgggaaaaaagaggccggtagagcactctcctgcggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccatctgtacaagcagatttccagccaatcaggagcctcaaacgacaaccactactttggctacagcaccccctgggggtattttgacttcaacagattccactgccacttttcaccacgtgactggcaaagactcatcaacaacaactggggattccggcccaagagactcagcttcaagctctttaacattcaagtcaaggaggtcacgcagaatgacggtacgacgacgattgccaataaccttaccagcacagttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgctgcgtactggaaacaactttaccttcagctacacctttgaagacgttcctttccacagcagctacgctcacagccaaagtctggaccgtctcatgaatcctctcatcgaccagtacctgtattacttgagcagaacaaacacaccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaacaaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttcctggcatggtctggcaggacagagacgtgtacctgcaggggcccatctgggcaaagattccacacacggacggacattttcacccttctcctcttatgggaggatttggactgaagcaccctcccccgcagattctcatcaagaataccccggtacctgcgaatccttcgaccaccttcagtgcggcaaagtttgcttctttcatcacacagtactccacggggcaggtcagcgtggagatagagtgggagctgcagaaagaaaacagcaaacgctggaaccccgagattcagtatacctccaactacaacaagtctgttaatgtggactttactgtggacactaatggcgtgtattcagagcctcgccccattggcacaagatacctgactcgtaatttgtaattgcttgttaatcaataaaccgtttaattcgtttcagttgaactttggtctctgtgtgcttctttcttatctagtttccatggctacgtagataagtagcatggagggttaatcattaactctaaggaacccctagtgatggag

SEQ ID NO: 33 - DNA, 4429 bp, Adeno-associated virus
ctccatcactaggggttcctggaggggtggagtcgtgacgtgaagtacgtcatagggttagggaggtcctgtattagaggtcacgtgagtgttttgcgacattttgcgacaccatgtgcttacgctgggtatttaagcccgagtgagcacgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacagaatggcgccgtgtgagtaaggcccccgaggccctcttctttgtgcaatttgagaagggagaaagctatttccacatgcacgtgctggtggagactaccggggtgaaatccatggttttgggacgtttcctgagtcagattcgcgaaaaactgattcagagaatttaccgcgggatcgagccgactttgccaaattggttcgcggtcacaaagactcgaaatggcgccggaggcgggaacaaggtggtggatgagtgctacatccccaattacctgctccccaaaacccaacccgagctccagtgggcgtggactaatatggaacagtatttaagcgcctgtttgaatctcgcggagcgtaaacggttggtggcgcagcatctgacgcacgtgtcgcagacgcaggagcagaacaaagagaatcagaatctcaattctgacgcgccggtgattagatcaaaaacctcagccaggtacatggagctggtcgggtggctcgtggataaggggattacctccgagaagcagtggattcaggaggaccaggcctcatacatttccttcaatgcggcctccaactcgcggtcccagatcaaggctgctctggacaatgcgggaaagatcatgagcctgactaaaactgcccccgactacctggtgggccagcagcccgtggaggacatttccggcaatcggatttataaaatcttggaactgaacgggtacgatccccaatacgcggcttccgtctttctgggatgggccacgaaaaagttcggaaagaggaacaccatctggctgtttgggcctgcaaccaccgggaagaccaacatcgcggaggccatagcccacacggtgcctttttacgggtgcgtgaactggaccaatgagaactttccgttcaatgattgcgtcgacaagatggtgatctggtgggaggaggggaagatgaccgccaaggtcgtggagtcggccaaagccattctcggaggaagcaaggtgcgcgtggaccaaaagtgcaagtcttcggcccagatagacccgactcccgtgattgtcacctccaacacaaacatgtgcgccgtgattgacgggaactcaacgaccttcgaacaccagcagccgttgcaagaccggatgttcaaatttgaactcacccgccgtctggatcatgactttggaaaggtcaccaagcaggaagtcaaagactttttccggtgggcaaaggatcacgtggttgaggtggagcatgaattctacgtcaaaaagggtggagctaaaaaaaggcccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatttgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatgtggtcaacgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaaaggagagccggtcaacgaggcagacgccgcggccctcgagcacgacaaggcctacgaccggcagctggaaagcggagacaacccgtacctcaagtacaaccacgccgacgcggagtttcaggagcgtcttaaagaagatacgtcttttgggggcaacctcggacgagcagtattccaggcgaaaaagagggttcttgaacctctgggcctggttgaggagcctgttaagacggctccgggaaaaaagaggccggtagagcactctcctgcggagccagactcctcctccggaactggaaagtcgggcaaccagcctgcaagaaagagattaaacttcggtcagactggagactcagactccgtacctgacccccagcctctcggacaaccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccatctgtacaagcagatttccagccaatcaggagcctcgaacgacaaccactactttggctacagcaccccctgggggtattttgacttcaacagattccactgccacttttcaccacgtgactggcaaagactcatcaacaacaattggggattccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtccttggctcggcgcatcaaggatgcctcccgccgttcccagcagacgtcttcatggtgccacagtatggatacctcaccctgaacaacgggagtcaggcggtaggacgctcttccttttactgcctggagtactttccttctcaaatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacacgccgagcggaaccaccacgcagtccaggcttcagttttctcaggccggagcgagtgacattcgggaccagtctaggaattggcttcctggaccctgttaccgccagcagcgagtatcaaagacacctgcggataataacaacagtgaatactcgtggactggagctaccaagtaccacctcaatggcagagactctctggtgaatccgggcccggccatggccagccacaaggatgatgaagaaaagtttttcccccaaagcggggttctcatctttgggaagcaaggctcagagaaaacaaatgtggacattgaaaaggtcatgattacagacgaagaggaaatcaggaccaccaatcccgtggctacggagcagtatggtactgtatctaccaaccttcagagcagcaacacacaagcagctacctcagatgtcaacacacaaggcgttcttccaggcatggtctggcaggacagagacgtgtacctgcaggggcctatctgggcaaagattccacacacggacggacattttcacccctctcccctcatgggcggattcggacttaaacaccctcctcctcagattctcatcaagaacaccccggtacctgcgaatccttcgaccaccttcagtgcggcaaagtttgcttccttcatcacacagtactccacagggcaggtcagtgtggagatcgagtgggagctgcagaaggagaacagcaaacgctggaatcccgagatccagtacacttccaactataacaagtctgttaatgtggactttactgtggacactaatggtgtgtattcagagcctcgccccattggcaccagatacctgactcgtaatctgtaattgcttgttaatcaataaaccgtttaattcgtttcagttgaactttggtctctggctcgttctttcttatctagtttccatggctacgtagataagtagcatggcgggttaatcattaactctaaggaacccctagtgatggag

SEQ ID NO: 34 - DNA, 4430 bp, Adeno-associated virus
ctccatcactaggggttcctggaggggtggagtcgtgacgtgaagtacgtcatagggttagggaggtcctgtattagaggtcatgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggcccccgaggccctcttctttgtgcaatttgagaagggagagagctatttccacatgcacgtgctcgtggaaaccacgggggtgaagtccatggttttaggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacctgctccccaaaacccagcctgagctccagtgggcgtggactaatatggaacagtatttaagcgcctgtttgaatctcgcggagcgtaaacggttggtggcgcagcatctgacgcacgtgtcgcagacgcaggagcagaacaaagagaatcagaatcccaattctgacgcgccggtgattagatcaaaaacctcagccaggtacatggagcttgtcgggtggctcgtggataaggggattacctcggagaagcagtggatccaggaggaccaggcttcatacatctccttcaatgcggcctccaactcgcggtcccaaatcaaggctgctctggacaatgcgggaaagatcatgagcctgactaaaaccgcccccgactacctggtgggccagcagcccgtggaggacatttccagcaatcggatttataaaatcttggaactgaacgggtacgatccccaatatgcggcttccgtctttctgggatgggccacaaaaaagtttggcaagaggaacaccatctggctgtttgggcctgcaactaccgggaagaccaacatcgcggaggccatagcccacacggtgcccttctacgggtgcgtaaactggaccaatgagaactttccctttaacgactgcgtcgacaagatggtgatctggtgggaggagggaaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatgtggtcaatgtggatttagatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcacaaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggagcctgttaagacggctccgggaaaaaagaggccggtagagcactctcctgtggagccagactcctcctccggaactggaaagtcgggccaacagcctgcaagaaagagattgaattttggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacctgggctctgcccacctacaacaaccatctgtacaagcagatttccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgctcacagccaaagtctggaccgtctcatgaatcctctcatcgaccagtacctgtattacttgagcagaacaaacacgccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccaccttaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctaccgcagatgtcaacacacaaggcgttcttcctggcatggtctggcaggatagagacgtgtacctgcaggggcccatctgggcaaagattccacacacagacggacattttcacccctctcccctcatgggcggatttggacttaaacaccctcctccacagattctcatcaagaataccccggtacctgcgaatccttcgaccacctttagtgcggcaaagtttgcttctttcatcacacagtattccacgggacaggtcagcgtggagatagagtgggagctgcagaaggagaacagcaaacgctggaatcccgagatccagtatacctctaactacaacaagtctgttaatgtggactttactgtggacactaatggcgtgtattcagagcctcgccccattggcaccagatacctgactcgtaatctgtaatttcttgttaatcaataaaccgtgtaattcgtttcagttgaactttggtctccgcgtacttcttttcttatctagtttccatggctacgtagataagtagcatggcgggttaatcattaactacaaggaacccctagtgatggag

SEQ ID NO: 35 - DNA, 4429 bp, Adeno-associated virus
ctccatcactaggggttcctggaggggtggagtcgtgacgtgaagtacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaagaatgggagttgccgccagattctgacatggatctgaatctgattgagcaggcacccctgaccgtggccgagaagctgcagcgcgactttctgacggagtggcgccgcgtgagtaaggccccggaggccctcttctttgtgcaatttgagaagggagagagctacttccacatgcatgtgctggtggagaccaccggggtgaaatccatggttttgggacgtttcctgagtcagattcgcgaaaaactgattcagagaatttaccgcgggatcgagccgactttgccaaactggttcgcggtcacaaagacccgaaatggcgccggaggcgggaacaaggtggtggatgagtgctacatccccaattacctgctccccaaaacccagcctgagctccagtgggcgtggactaatatggaacagtatttaagcgcctgtttgaatctcgcggagcgtaaacggttggtggcgcagcatctgacgcacgtgtcgcagacgcaggagcagaacaaagagaatcagaatcccaattctgacgcgccggtgattagatcaaaaacctcagccaggtacatggagctggtcgggtggctcgtggataaggggattacctcggagaagcagtggatccaggaggaccaggcctcatacatctccttcaatgcggcctccaactcgcggtcccagattaaggctgctttggacaatgcggggaagatcatgagcctcactaaaaccgcccccgattacctggtgggccaacagcccgtggatgacatttccagcaatcggatttataaaatcttggaactgaacgggtatgatccgcaatacgcggcttccgtcttcctgggatgggctacgaaaaagttcggcaagaggaacaccatctggctgtttgggcctgcgaccacggggaagaccaacatcgcggaggctatagcccacactgtgcctttttacgggtgcgtaaactggaccaatgaaaactttccgttcaacgactgcgtcgacaagatggtgatctggtgggaggagggaaagatgaccgccaaggttgtggagtcggccaaagccattctcggcggaagcaaggtgcgagtggaccagaaatgcaagtcctcggcccagatagacccgactcccgtgatcgtcacctccaacaccaacatgtgcgccgtgattgacgggaactcaacgaccttcgagcaccagcagccgttgcaagaccggatgttcaaatttgaactcacccgccgtctggatcatgactttgggaaggtcaccaagcaggaagtcaaagactttttccggtgggcccaagaccacgtggtagaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatttgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtaccagacgcttgcactgcttgcaacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggagcctgttaagacggctccgggaaaaaagaggccggtagagcactctcctgcggagccagattcctcctccggaactggaaagtcgggccaacagcctgcaagaaagagattgaattttggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccatctgtacaagcagatttccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgctgcgtactggaaacaactttaccttcagctacacctttgaagacgttcctttccacagcagctacgctcacagccaaagtctggaccgtctcatgaatcctctcatcgaccagtacctgtattacttgagcagaacaaacacgccaagcggaaccaccacgatgtccaggcttcagttttctcaggccggagcaagtgacattcgggaccagtctagaaactggcttcctggaccctcttaccgccagcagcgagtatcaaagacagctgcggacaacaacaacagtgattactcgtggactggagctaccaagtaccaccttaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctaccgcagatgtcaacacacaaggcgttcttccaggaatggtctggcaggacagagacgtgtacctacagggacccatctgggcaaagattccacacacggacggacattttcacccctctcccctcatgggcggattcggacttaaacaccctcctccacagattctcatcaagaacaccccggtacctgcgaatccttcgaccactttcagtgcggcaaagtttgcttccttcattacacagtactccacggggcaggtcagcgtggagatcgagtgggagctgcagaaagagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtgtaattcgtttcagttgaactttggtctctgtgtacttctttcttatctagtttccatggctacgtagataagtaccatggcgggttaatcattaactctaaggaacccctagtgatggag

SEQ ID NO: 36 - DNA, 4430 bp, Adeno-associated virus
ctccatcactaggggttcctggaggggtggagtcgtgacgtgaagtacgtcatagggttagggaggtcctgtattagaggtcacgtgagtgttttgcgacattttgcgacaccatgtggttacgctgggtatttaagcccgagtgagcacgcagggtctccattttgaagcgggaggtttgaacgcgcagccgccatgccggggttttacgagattgtgattaaggtccctagcgaccttgacgagcatctgcccggcatttctgacagctttgtgaactgggtagccgagaaggaatgggagttgccgccagattctgacatggatctgaatctgattgagcaggcacccctgaccgtggccgagaagctgcagcgcgactttctgacagaatggcgccgtgtgagtaaggcccccgaggcccttttctttgtgcaatttgagaagggagagagctatttccacatgcacgtgctcgtggaaaccacgggggtgaagtccatggtgttaggacgtttcctgagtcagattcgcgaaaaactgattcagagaatttaccgcgggatcgagccgactttgccaaattggtttgcggtcacaaagacccgaaatggcgctggaggcgggaacaaggtggtggatgagtgctacatccccaattacctgctccccaaaacccaacctgagctccagtgggcgtggactaatatggaacagtatttaagcgcctgtttgaatctcgcggagcgtaaacggttggtggcgcagcatctgacgcacgtgtcgcagacccaggagcagaacaaagagaatcagaatcccaattctgacgcgccggtgatcagatcaaaaacctcagccaggtacatggagctggtcgggtggctcgtggataaggggattacctccgagaagcagtggattcaggaggaccaggcctcatacatctccttcaatgcggcctccaactcgcggtcccaaatcaaggctgctctggacaatgcgggaaagatcatgagcctgactaaaacggcccccgactacctggtgggccagcagcccgtggaggacatttccggcaatcggatttataaaatattggaactgaacgggtacgatccccaatacgcggcttccgtctttctgggatgggccacgaaaaagttcggcaagaggaacaccatctggctgtttgggcctgcaactaccgggaagaccaacatcgcggaggccatagcccacacggtgcccttctacgggtgcgtaaactggaccaatgagaactttccctttaacgactgcgtcgacaagatggtgatctggtgggaggaggggaagatgaccgccaaggttgtggagtcggccaaagccattctcggcggaagcaaggtgcgcgtggaccaaaagtgcaagtcttcggcccagatcgaccccactcccgtgatagtcacctccaacaccaacatgtgcgccgtgattgacgggaactcaacgaccttcgagcaccagcagccgttgcaagatcggatgttcaaatttgaacttacccgccgtctggatcatgactttggaaaggtcaccaagcaggaagtgaaagactttttccggtgggcaaaggatcacgtggttgaggtggagcatgaattctacgtcaaaaagggtggagctaagaaaaggcccgcccccagtgacgcagatataagtgagcccaaacgggcgcgcgagtcagttgcgcagccatcgacgtcagacgcggaagcttcaatcaactacgcggacaggtaccaaaacaaatgttctcgtcacgtgggcatgaatctgatgctgtttccctgcagacaatgcgagagaatgaatcaaaattcaaatatctgctttactcacggacagaaagactgtttagagtgctttcccgtgtcagaatctcaacccgtttctgtcgtcaaaaaggcgtatcagaaactttgctacattcatcatatcatgggaaaagtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcaaaaaagagggttcttgaacctctgggcctggttgaggagcctgttaagacggctcctggaaaaaagaggccggtagagcactctcctgcggagccagattcctcctccggaactggaaagtcgggccaacagcctgcaagaaaaagactgaatttcggtcagactggagactcagactccgtaccagaccctcaacctctcggagaaccaccagcagcccccacaagtttgggatctactacaatggcttcaggcggtggcgcaccagtggcagacaataacgagggtgccgatggagtgggtaattcctcgggaaattggcattgcgattcccaatggctgggcgacagagtcatcaccaccagcacccgaacctgggccctgcccacctacaacaaccatctgtacaagcagatatccagccagtctggagccagcaacgacaaccactacttcggctacagcaccccctgggggtattttgacttcaacagattccactgccacttttcaccacgtgactggcaaagactcatcaacaacaactggggattccggcccaaaagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtattcatggtgccacagtatggatacctcaccctgaacaacgggagtcaggcggtaggacgctcttcattttactgcctggagtacttcccttctcagatgctgcgtacaggaaacaacttccaattcagctacacctttgaggacgttcctttccacagcagctacgctcacagccagagtctggatcggctgatgaatcctctgatcgaccagtacctgtattatctgaacaagacacaatcagccagtggaactgttcagcagtctcggctactgtttagccaagctggacccaccagcatgtctcttcaagctaaaaactggctgcctggaccttgctacagacagcagcgtctgtcaaagcaggcaaacgaaaacaacaacagcaactttccctggactgcggctaccaagtatcatctaaatggccgggactcgttggttaatccaggaccgcctatggcaagtcacaaggatgacgaagaaaagtttttccccatgcacggaaccctgatatttggtaaagaaggaacaaatgctaacaacgcagaattggaaaatgtcatgattacagatgaagaagaaatccgcaccacaaatcctgtagctacagagcagtacggcaatgtgtcaaataatttgcaaaactcaaatactgctccgagtactggaactgtcaatcaccaaggagcgttacctggtatggtgtggcaggatagagacgtgtacctgcagggacccatttgggccaagattcctcacaccgatggacactttcatccttctccgctgatgggaggttttggactcaaacacccacctcctcagatcatgatcaaaaacactcccgttccagccaatcctcctacaaacttcagtgcggcaaaatttgcttcctttatcacacagtattccacggggcaggtcagcgtggaaatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtacttcttttcttatctagtttccatggctacgtagataagtagcatggagggttaatcattaactacaaggaacccctagtgatggag

SEQ ID NO: 37 - DNA, 2977 bp, Adeno-associated virus
ggtgcgtaaactggaccaatgagaactttcccttcaacgactgcgtggacaagatgctcatctggtgggaggagggcaagatgaccaacaaggtggtcgagtccgccaaggccatcctgggcggctcccgtgtgagagtggaccagaagtgtaagtcttctgcccagatagacgccaccccggtcatcgtcacctccaacaccaacatgtgtatcgtggtggacggaaactcgacgacgttcgaacatcagcagccgctggaggaccgaatgttcaagtttgagctgacgaagcggctcccgccggactttggcaagatcaccaagagggaggtcaaagacttttttgcctgggctgaggccaatctggtgccggtgactcatgagtttcgggttcccaagggggcggagaaatctctgaaacgcccactcagtgacgtcactgacactagctataaaagtccggagaagcgggcgagggtctcatttgctccggagacgcccgactgttcggacgagaccgccgaccccgctcctccgcgaccgatcgattggacctccaggtatgattgtcgatgcgattcgcatgctcgcgtcgagactgttgatgaaatgtgtgaggaatgcgaatatctgaatcggggcaaaaacggttgtatccctcataaaatgaactattgtcaaatctgtcatgatgtacccccctggctaaaggaaaaagtgtctgatgtagtggatcttgacgatgccaataaagagcagtaaataaagcgagtagtcatgtcgtttgttgatcaccctccagattggcttgaggagattggtgagggtctaaaggagtttttgggactcgaacctggcccacccaaaccgaagcccaaccagcagaagcaagacgacgcccgtggtcttgtactgcctggatataattacctgggacccggaaacggtctcgaccgcggagaacctgtcaaccgggctgacgaggtcgcgcgagagcacgacatctcgtacaacgagcagctccaggcgggagacaacccctacctcaagtacaaccacgcggacgccgagtttcaggagaagctcgcggacgacacctccttcgggggcaacctcggcaaggcagtctttcaggccaaaaaaagggttctcgaaccttttggcctggttgaggagcctgttaagacggctgctaaaggcgagcggatagacgaccactatcccaaaaagaagaaggctcggatcgaagagaccgaagctggaaccagcggagcccagcagctgcagatcccagcccaaccagcctcaagtttgggagctgatacaatgtctgcgggaggtggcagcccactgggcgacaataaccaaggcgccgatggagtgggcaatgcctcgggagattggcattgcgattccacgtggatgggggaccgagtcatcaccaagtccacccgaacctgggtgctgcccagctacaacaaccatcagtaccttgagatccacagcggttccgtcgacggaagcaacgctaacgcttattttggatacagcaccccctgggggtactttgacttcaaccgcttccacagccactggagcccccgagactggcagcgactcgtcaacaactactggggattcagaccccggtccctcaaggtcaagatctttaacatccaagtcaaggaagtcacgacgcaggacggcaccaccaccatcgccaacaacctcacctccaccgtccaagtgtttacggacaacgactaccagctaccgtacgtcatcggcaacggaacggaggggtgcctgccggccttccctccgcaggtctttacgctgccgcagtacggctacgcgacactgaaccgtaacaacaccgacgatcccaccgagcggagcagtttcttctgcctggaatactttcccagcaagatgctgcggacgggcaacaactttgaattcacctacagcttcgaggaggtgcccttccactgcagcttcgctcccagccagaacctcttcaagctggccaatccgctggtggaccagtacctgtaccgctttgtgagcaccgacacttccggtaacctacagttccaaaagaacttgaaggccagatatgccaacacttacaagaattggtttccggggcccatgtgccggacccagggctggtacacaagcgcgggcacatataacaacaaaggcgttgccaactttgatacttcaaacaagatggaactggagggggctagttaccaagtaaaccctcaaccaaatggaatgacaaacacgcttcaggatagtaacaaatacgcgcttgaaaacaccatgatcttcaacgcacagaacgcccctccgggaacgacctctctgtaccaggagaacaatcttttgataaccagcgagagcgagacgcagcctgtgaaccgattggcctacaacaccggtggtcaggtatcaaacaacaaccagaattcaaatacacatcctacggtcggagtatacaatcaccaggaagtgttgcctggtagcgtgtggatggacagagacgtataccttcagggccccatctgggccaaaatcccggagacaggggcacactttcatccttctccggctatgggcggattcggactcaaacacccaccgcccatgatgctcatcaagaacacaccggtacctagcaacgtcgctgccttctctgacgtgcccgttaaaagcttcatcacccagtacagcaccggacaggtcacggtggagattgaatgggagctcaagaaagaaaactccaagaggtggaatcccgagatacagtacaccaacaactacaacaaccctacattcgtggactttgctccagacacctccggcgagtacaggactacgagggctattggaacccgttaccttacccgacccctgtaaccctatcctgtcacatgttttcaataaaccggttaattcgtttcagt

SEQ ID NO: 38 - DNA, 4259 bp, Adeno-associated virus
tttgcgacattttgcgacaccacgtggccattcagggtatatatggccgagtgagcgagcaggatccccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatctgaatctgattgagcaggcacccctgaccgtggccgagaagctgcagcgcgacttcctggtccaatggcgccgcgtgagtaaggccccggaggccctcttctttgttcagttcgagaagggcgagtcctacttccacctccatattctggtggagaccacgggggtcaaatccatggtgctgggccgcttcttgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcgtgtttgaacctggccgagcgcaaacggctcgtggcgcagcacctgacccacgtcagccagacccaggagcagaacaaggagaatctgaaccccaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgctctggacaatgccggcaagatcatggcgctgaccaaatccgcgcccgactacctggtaggccccgctcctcccgcggacattaaaaccaaccgcatctaccgcatcctggagctgaacggctacgaccctgcctacgccggctccgtctttctcggctgggcccagaaacggttcgggaagcgcaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaaaaggacgtatcggaaactctgtgcgattcatcatctgctggggcgggctcccgagattgcttgctcggcctgcgatctggtcaacgtggacctggatgactgtgtctctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccgcgtgactggcagcgactcatcaacaacaattggggattccggcccaagagactcaacttcaagctcttcaacatccaagtcaaggaggtcacgacgagtgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacaggcaacaacaacagcaattttacctggactggtgcttcaaaatataacctcaatgggcatgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacacaccctgcgaccggagatgtgcatgttatgggagcattacctggcatggtgtggcaagatagagacgtgtacctgcagggtcccatctgggccaaaattcctcacacagatggacactttcacccgtctcctcttatgggcggctttggactcaagcacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttaccgtggacaacaatggactttatactgagcctcgccccattggcacccgttaccttacccgtcccctgtaattacgtgttaatcaataaaccggttgattcgtttcagttgaactttggtctcctgtcc

SEQ ID NO: 39 - DNA, 4222 bp, Adeno-associated virus
ttgcgacattttgcgacaccatgtggccattcagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatctgaatctgattgagcaggcacccctgaccgtggccgagaagctgcagcgcgacttcctggtccaatggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcgtgtttgaacctggccgagcgcaaacggctcgtggcgcagcacctgacccacgtcagccagacccaggagcagaacaaggagaatctgaacccgaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgctctggacaatgccggcaagatcatggcgctaaccaaatccgcgcccgactacctggtaggccccgctccgcccgcggacattaaaaccaaccgcatttaccgcatcctggagctgaacggctacgaccctgcctacgccggctccgtctttctcggctgggcccagaaaaggttcgggaagcgcaacaccatctggctgtttgggccggccaccacgggcaagaccaacatcgcggaagccatcgcacacgccgtgcccttctacggctgcgtcaactggaccaatgaaaactttcccttcaacgactgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggtctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcaccccaagaaccagactcctcctcgggcattggcaaatcaggccagcagcccgctaaaaagagactcaattttggtcagactggcgactcagagtcagtccccgacccacaacctctcggagaacctccagcaacccccgctgctttgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaactggggattccggcccaagagactcaacttcaagctcttcaacatccaagtcaaggaggtcacgacgaacgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctgacgctcaacaatggcagcaaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagcattacctggcatggtgtggcaagatagagacgtgtacctgcagggtcccatttgggccaaaattcctcacacggatggacactttcacccgtctcctcttatgggcggctttggactcaagcacccgcctcctcagatcctcatcaaaaacacacctgttcctgcgaatcctccggcagagttttcggctacaaagtttgcttcattcatcacccagtactccacaggacaagtgagcgtggaaattgaatgggagttgcagaaagaaaacagtaagcgctggaatcccgaagtgcagtacacatctaattatgcaaaatctgccaacgttgacttcactgtggacaacaatggactttatactgagcctcgccccattggcacccgttacctcacccgtcccctgtaattacttgttaatcaataaaccg

SEQ ID NO: 40 - DNA, 4684 bp, Avian adeno-associated virus
tggccagtttccaaaacaggctcgctcgctcactcggggcgcgacgccaaaggcgtcgcagcgaccccttcggggtcgcgccccgagtgagcgagcgagcctgttttggaaactggccagcactccggtgaggtaatgccgtcacgtggtaccgcacgtgaataggaaatctcgcgagaacgtaaacaaatataagacgacgccacgccgcgccgcgtcatacgcgcgcgcgcaccggcgagatgaggtcgtactacgaggtcatcgttcagctgcccaacgacgtcgagagtcaggtacctggaatctcggattcgttcgtcaactggattacgtcgcgagaatggacgttgcctgaggacgccgattgggatttggaccaggtcgatcaagttcaactgacgctcggcgacaaaatccaacgggagattcgaaatcattgggggacaatggccaaagaaccggactttcactattttatccaactcgaacaaggtgaggtgttctttcatttgcacgtcctgctggaaacgtgttccgtcaagccgatggtgctcgggcgatacattcggcatattcagcaaaagatcgtgagtaaagtctactgcggacacgaacccgcgatggaaggatggatgcgtgtgaccaaaaccaagaattttgggggcgcgaacaaggttcgggccgaatcatatattcccgcctacctgattccgaaacagcaaccggaagtgcagtgggcgtggactaacgtgcccgagtatataaaagcgtgcctgcaccgagaactgcgtgccagtctcgcgcgacttcacttcgaggaggcggggctctcgcagtccaaggaaaatctcgcgagaactgcagacggcgctcccgtgatcgcgacccgcgtcagcaaacgctacatggagctcgtggattggctcgtggagaaggggatcaccaccgagaaggaatggctgctggaaaacagagaaagctttcggagctttcaagcctcgagcaactcggcgcgtcagatcaagacggctctacaaggcgccattcaggagatgcttctgaccaagacggcggaggactacctcgtcggaaaggatcccgtctcggacgacgagattcgtcagaatcgcatctacaagatcctggaactgaaccactacgacccggcgtatgtggggagtattttggtcgggtggtgccagaagaaatggggcaagcgaaacacgctgtggctgttcggacctgcgaccaccggcaagaccaacatcgcggaggctattgcccatgctgtgccgttctatggatgcgttaactggaccaacgagaactttccgttcaacgactgcgtcgaaaagatgattatctggtgggaggagggcaaaatgaccgccaaagtggtggaaacggccaaggcgattctggggggatctcgggtgagagtggatcaaaaatgcaaagcttcggttcctattgaaccgacgtcggtcattattaccagtaacaccaacatgtgttatgtcatcgacgggaacacgactacgttcgagcataagcagccgttggaggacaggatgtttaagctcgagctgttgactcgtttacccgatgactttggtaaggtgaccaaacaggaggtgcgtcaattcttcaggtggtcccaggatcacctgacgcccgtgatcccagaattcctggtgcggaaggcggagtctcgcaaaagacccgccccttccggggaaggctatataagcccgaccaagaagcccgcgctcgcagagcagcagcaggcgtcggagagcgcggagccggttcccaccaggtatcgtatcaaatgctcgaaacattgcgggatggataaaatgttgtttccttgccaaatttgtgaatcgatgaacagaaatattaatatatgtgcgattcataaaacaacggaatgtaaagaatgttttccggaatacggggataaaaaggacactgtaccagaactacccccctgtacagaacataacgtgtctcgttgttatcaatgtcattcgggcgaattgtatcgcgtgacttcggactctgacgagaaacctgcccccgcgagtgatgaaggcactgagccatcctatgctccctgcacgattcaccacttgatgggcaagagtcgcgggttagtgtcgtgtgctgcatgtcggttaaaaaatagtacattgcatgatgacttggacgatggcgatctcgaacaataaatgattgaaatatagccatgtctcttatttctgatgcgattccagattggttggagcggttggttcgcaagggagtcaacgctgcggctgacttttatcatttggagagcggtcctcctgctcctaaggccaatcagcaaactcaagaatctcctgaaaaggacgattctagaggtctcgtgttcccgggttacaagtatctaggcccttttaacggtctagataaaggagaacccgtcaacgaggcagacgctgccgccttagagcacgacaaggcttacgacctcgaactcaaggacgggcacaacccgtactttgagtacaacgaggccgatagacgtttccaggaacgtctcaaagacgatacctctttcggggggaatctcggtaaagctatctttcaggccaaaaagagggtcctcgagccctttggtctgattgaacaacccgacaacacggccgggaccggggagaagcgtcccgaacgcgtcgacgactttttcccgaaaaagaagaaggccaagaccgagcaaggcaaaacccctgctcaaacgggcgaagaccccggagaaggaacctcttccaacgctggatcaagcgccccctctagtgtgggatcatctgtcatggctgaaggaggtggcggcccagtgggcgatgcaggccagggtgccgatggagtgggcaattcctcgggaaattggcattgcgattcccaatggctggacaacggagtcgtcactcgaaccacccgaacctgggtcttgcccagctacaacaaccacctgtacaagcggatccaaggaccgggaggaaccgacaacaacaacaaatactttggattcagcaccccctgggggtactttgactacaaccgattccactgccacttttctccgcgagactggcaaagactcatcaacaacaactggggcatccgacccaaagcgatgcgctttagactctttaacatccaggtcaaagaagtcacggtccaagactccaacaccaccattgccaacaacctcaccagcacggtccaagtctttgcggacaaggactaccagctgccgtacgtcctcggatcggctaccgaaggcaccttcccgccgttcccagcggatatctacacgatcccgcagtatggttactgcacgctaaactacaacaacgaggcggtggatcgttcggccttctactgtctggactactttccctcagacatgctgcggacaggaaataactttgaattcacttacacgttcgaggacgttcctttccatagcatgtttgcccacaaccagacgctagaccggctgatgaatcccctcgtcgatcagtacctctgggccttcagctccgtcagccaacccagctcgggtcagagacggctcaattattccagaggcactaaaaacaatatggcggtccaatacaagaactggttacccggacccttcttcagggatcagcaaatctatacaggggctagcaacatcacccaaaacaacgtttttaacgtttgggacaaaggcaagcagtgggtgatagacaatcggaccaacctaatgcagcccggccctgctgcagcgaccacctttagcggagaacccgaccgtcaagccatgcaaaacacgctggcttttagtcggacggtctacgaccagacaactagtacggccgatcgtaaccagttgctcattaccaacgaagatgaaatcagacccaccaactcggtcggtattgacgtgtggggagtagttcccaacaaccaacagtccaacgtgtcccctggaaatcgcacaggtgtcaacaaccaaggggcgcttcccgggatggtgtggcaaaacagagacatttacctccaaggacccatttgggccaaagtccccgacaccgacaatcacttccacccgtctcctcttattggcggattcgggtgcaagcaccctcctccccaaattttcattaaaaatacccctgtccctgccaaccctccggaaacgttccagacggccaaggtggcctccttcatcaaccagtactcgaccggacagtgcaccgtcgaaatcttttgggaactgaagaaggaaacctccaaacgctggaaccccgaaatccagttcacctccaactttggcaacgcggccgacatccagttctccgtctccgacaccggactctattccgaacctcgtcccatcggtacccgttacctcaccaaaccgctgtaaatttaaacccttcaataaaccgtttatgcgtaactgtacttccgtctcctgtcgttattcggtcacatgatgcggcattacctcaccggagtgctggccagtttccaaaacaggctcgctcgctcactcggggcgcgacgccaaaggcgtcgcagcgaccccttcggggtcgcgccccgagtgagcgagcgagcctgttttggaaactggcca

SEQ ID NO: 41 - DNA, 4682 bp, Avian adeno-associated virus
tggccagtttccaaaacaggctcgctcgctcactcgggccgcgacgccaaaggcgtcgctaccggcgccttcggggccgcggcccgagtgagcgagcgagcctgttttggaaactggccagcactccggtgaggtaatgccgtcacgtggtcgggaacgggaacgggaaatctcgcgagaacgtaaacagatataagacggcgccacacggcgctgcgtcatacgcgcgcgcgcaccggcgagatgaggtcgtactacgaggtcatcgttcagctgccgaacgacgtcgagagtcagatacctggaatctccgattcgttcgtcaactggattacgtcgcgagaatggacgttgccggaagacgccgattgggatttggaccaggtcgatcaagttcagctgacgctgggagacaaaatccaacgggagattcgaaatcattgggggacgatggccaaagaacccgactttcactattttatccaactggaacaaggtgaggtgttctttcatttgcacgtcctgctggaaacgtgttccgtcaagccgatggtgctcggaagatatattcgacatattcaacaaaaaattgtgagtaaagtctactgcggccacgagcccgcgatggaaggatggatgcgggtgaccaagaccaaaaattttgggggcgcgaacaaggtccgggccgagtcgtatattcccgcctacctgatcccgaaacagcaaccggaagtgcagtgggcgtggactaacgtgcccgagtatataaaagcgtgcctgcaccgagacctgcgtgccagtctcgcgcgacttcacttcgaggaggcggggctctcgcagtccaaggaaaatctcgcgagaactgcagacggcgctcccgtgatcgcgacccgcgtcagcaaacgctacatggagctcgtagattggctcgtggagaaggggatcaccaccgagaaggaatggctgctagaaaacagagaaagctttcggagctttcaggcctcgagcaactcggcgcgtcagatcaagacggccctgcaaggcgccattcaggagatgctactgaccaagacggcggaggactacctcgtcggaaaggatcccgtctcggacgacgacattcgtcagaaccgcatctacaagattttggaactgaaccactacgacccggcgtacgtggggagtattttggtcgggtggtgccagcggaaatggggcaagcgaaacacgctgtggctgttcggacctgcgaccaccggcaagaccaacatcgcggaggctattgcccatgctgtaccgttctatggatgcgttaactggactaacgagaactttccgttcaacgactgcgtcgaaaagatgattatctggtgggaggagggcaaaatgaccgccaaggtggtggaaacggctaaagccatcctggggggatcacgggtacgggtggatcagaaatgtaaggcctcggttccgatcgaaccaactcctgtcatcatcaccagcaacaccaacatgtgctatgtcatcgacgggaacacgaccacgttcgagcataagcagccgttggaggacaggatgtttaagctcgaattgctgactcggttgcccgatgaatttggcaaggtgtcaaaacaggaggtgcgccaatttttcaggtggtcccaggatcacctgatgcccgtaatcccagaattccttgtgcggaaggcggagtctcgcaaaagacccgccccttccggggaaggctatataagcccgtcaaagaagcccgcgctcgcagagcagcagcaggcgtcggagagcgcggacccggttcccaccaggtatcgtatcaaatgctcgaaacattgcgggatggataaaatgttgtttccttgtcaaatttgcgaatcgatgaatagaaatatcaacatttgtgcgattcataagacaaccgaatgtaaagaatgttttccggaatacggggataaggacactgtaccagaactacccccctgtacagaacataacgtgtctcgttgttatcaatgtcactcgggtgaactgtatcacgtgactgcggactctgacgagaaatcggcccccgagatcgatgactgcatcgagccgacctatgctccctgcacgattcattacatgatgggcaagagtcgcgggttagtgtcttgtgccgcgtgtcgtttgaaaaatagtacattgcacgatgacttggatgacggtgatctcgaacaataaatgattgaaatatagccatgtctcttatttctgatgcgattccagattggttggagcgattggttcgcaagggagtgaatgctgcagctgatttctaccatttggaaagcggtcctcctgctcctaaggcaaatcagcaaactcaagaatctcctgaaaaggacgattcgcgaggtctcgtgttcccgggttacaagtatctaggccctttcaacggtctagataaaggagaacccgtcaacgaggcagacgctgccgccttagagcacgacaaggcttacgacctcgagatcaaagacgggcacaacccgtactttgagtacaacgaggccgacagacgtttccaggaacgtctgaaagacgatacctctttcggagggaatctcggtaaagcgatctttcaggccaaaaagagggtgctcgagccctttggtctgattgaacaacccgacaacacggccgggaccggggaaaagcgtcccgaacgcgtcgacgactttttcccgaaaaagaagaaggccaagaccgagcaaggcaaagcccctgctcaaacgggcgaagaccccggagaaggaacctcttccaacgctggatcaagcgccccctctagtgtgggatcatctgtcatggctgaaggaggtggcggtccaatgggcgatgcaggccaaggtgccgacggagtgggcaattcctcgggaaattggcattgcgattcccaatggctggacaacggagtcgttacccgaaccactcgaacctgggtcctgcccagctacaacaaccacttgtacaagcggatccaaggaccgggaggaaccgaccccaacaataaatactttggattcagcaccccctggggatactttgattacaaccgattccactgccacttttctccgcgagactggcaacgactcatcaacaacaactggggcatccgtcccaaagcgatgcgctttagactctttaacatccaggtcaaagaagtcacggtccaagactccaacaccaccatcgccaacaacctcaccagcacggtccaagtctttgcggacaaggactatcagctgccgtacgtcctcggatcggctacagagggcaccttcccgccgttcccagcggatatctacacgatcccgcagtacggttactgcacactaaactacaacaacgaggcggtggatcgttcggccttctactgtctggactatttcccctcagacatgctgcggacaggaaataactttgagttcacttacacgttcgaggacgttcctttccatagcatgtttgcccacaaccagacgctagaccggctgatgaatcccctcgtcgatcagtacctgtgggccttcagctccgccactcaggcgggatcctctggacggaagctcaattattccagaggcactaaaaccaatatggcggtccaatacaagaactggttacctggacccttcgtccgggatcagcaaatctttacgggggctagcaacatcaaccaaaacaacgtgttcaacgcttgggataaaagcaagcagtgggtgatagacaatcgggtcaatatgatgcagcccggccctgcagcagcgaccagctttagcggagaacccgaccgtcaagccatgcaaaacacgctggcctttagtcggacggtctacgaccagacatccagtacggccgatcgtaaccagttgctcattaccaacgaagatgaaatcagacccaccaacccggtcggcatcgacacgtggggagtagttcccaacaacaaccagtccaacgtgtccgccggcactcgcgcggccatcaacaaccaaggggcgcttcccgggatggtgtggcaaaacagagacatttacctccaaggacccatttgggccaaaatccccgacacagacaatcatttccacccatctcctcttattggcggattcgggtgcaagcaccctcctcctcaaattttcattaaaaatacccctgtccctgccaacccttcggaaacgttccagacggccaaggtggcctccttcatcaaccaatactcgaccggacagtgcaccgtcgaaatcttttgggaactgaagaaggaaacttccaaacgctggaaccccgaaatccagttcacctccaatttcggcaacgcggccgacatccagtttgccgtctccgacaccggatcctactccgaacctcgtcccatcggtacccgttaccttaccaaacctctgtaaattaaacccttcaataaaccgtttatgcgtaactgtatttccgtctcctgtcgttattcagtcacatgatgcggcattacctcaccggagtgctggccagtttccaaaacaggctcgctcgctcactcgggccgcgacgccaaaggcgtcgctaccggccccttcggggccggggcccgagtgagcgagcgagcctgttttggaaactggcca

SEQ ID NO: 42 - DNA, 4694 bp, Avian adeno-associated virus
tggccagtttccaagacaggctcgctcgctcactcgggccggggccccaaaggggcccctagcgaccgcttcgcggtcgcggcccgagtgagcgagcgagcctgtcttggaaactggccagcactccggtgaggtaatgccgtcacgtggtcgggaatgggaacgggaaatctcgcgagaacgtaaacaaatataagacggcgccacacggcgctgcgtcatacgcgcgcgcgcaccggcgagatgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataaatgattgaaatgtagccatgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaaattaaacccttcaataaaccgtttatgcgtaactgtatttccgtctcctgtcgttattcagtcacatgatgcggcattacctcaccggagtgctggccagtttccaagacaggctcgctcgctcactcgggccggggccccaaaggggcccctagcgaccgcttcgcggtcgcggcccgagtgagcgagcgagcctgtcttggaaactggcca

SEQ ID NO: 43 - DNA, 4682 bp, Avian adeno-associated virus
tggccagtttccaaaacaggctcgctcgctcactcgggccccggccccaagggggccggtagcgacgcctttggcgtcgcggcccgagtgagcgagcgagcctgttttggaaactggccagcactccggtgaggtaatgccgtcacgtggtcgggaacgggaacgggaaatctcgcgagaacgtaaacaaatataagacgacgccacacggcgctgcgtcatacgcgcgcgcgcaccggcgagatgaggtcgtactacgaggtcatcgttcaactgccgaacgacgtcgagagtcaggtacctggaatctccgattcattcgtcaactggattacgtcgcgagaatggacgttgccggaagacgccgattgggatttggaccaggtcgatcaagttcaactgacgctcggcgacaaaatccaacgggagattcgaaatcactgggggacgatggcgaaagaaccggactttcactattttatccaactggaacaaggtgaggtgttctttcatttgcacgtcctgctggaaacgtgttccgtgaagccgatggtactcggaagatatattcgacatattcaacaaaaaattgtcagtaaagtctactgcggccacgagcccgcgatggaaggatggatgcgggtgaccaagaccaaaaatttcgggggcgcgaacaaggtccgggccgagtcgtatattcccgcctacctgattccgaaacagcaaccggaagtgcagtgggcgtggactaacgtgcccgagtatataaaagcgtgcctgcaccgagaactgcgtgccagtctcgcgcgacttcacttcgaggaggcggggctctcgcaatccaaggaaaatctcgcgagaactgcagacggcgctcccgtgatcgcgacccgcgtcagcaaacgctacatggagctcgtggattggctcgtggagaaggggatcaccaccgagaaggaatggctgctggaaaacagagaaagctttcggagcttccaggcctcgagcaactcggcgcgtcagatcaagacggccctgcaaggcgccatccaggagatgcttctgaccaagacggcggaggactacctcgtcggaaaagaacccgtctcggacgacgagattcgtcagaaccgcatctacaagattttggaactgaaccactacgacccagcgtacgtggggagtattttggtcgggtggtgccagaagaaatggggcaagcgaaacacgctgtggctgttcggacctgcgaccaccggcaagaccaacatcgcggaggctattgcccatgctgtgccgttctatggatgcgttaactggaccaacgagaactttccgttcaacgactgcgtcgaaaagatgattatctggtgggaagagggcaaaatgaccgccaaggtggtggaaacggctaaagcgattctgggaggatctcgggtgagagtggaccaaaaatgcaaagcttcggttccgatcgaaccgacgccggtcattattaccagtaacaccaacatgtgttatgtcatcgacgggaacacgactacgttcgagcataagcagccgttggaggacaggatgtttaagctcgagctgttgactcgtttacccgatgactttggtaaggtgaccaaacaggaggtgcgtcaattcttcaggtggtcccaggatcacctgacccctgtgatcccagaattcctggtgcggaaggcggagtctcgcaaaagacccgccccctccggggaaggctatataagcccgacaaagcggcccgcgctcgcagagcagcagcaggcgtcggagagcgcggagccggttcccaccaggtatcgtatcaaatgctcgaaacattgcgggatggataaaatgttgtttccttgccaaatttgtgaatcgatgaacagaaatattaatatatgtgcgattcataaaacaacggaatgtaaagaatgttttccggaatacggggataaggacactgtgccagaactacccccctgtacagaacataacgtgtctcgttgttatcaatgtcattcgggcgaattgtatcgcgtgacttcggactctgacgagaaacccgcccccgagagtgatgaaggcactgagccatcctatgctccctgcacgattcaccatttgatgggcaagagtcgcgggttagtgtcgtgtgctgcatgtcgtttgaaaaatagtacgttgcatgatgacttggatgacggtgatcttgaacaataaatgattgaaatatagccatgtctctcatttctgatgcgattccagattggttggagcggttggtcaaaaagggagtgaatgctgcggctgatttctaccatttggaaagcggtcctcctcatcctaaggcaaatcagcaaactcaagaatctcctgaaaaggacgattcgagaggtctcgtgttcccgggttacaagtatctaggccctttcaacggtctagataaaggaaaacccgtcaacgaggcagacgctgccgccttagagcacgacaaggcttacgacctcgaactcaaggacgggcacaacccgtactttgagtacaacgaggccgatagacgtttccaggaacgtctcaaagacgatacctctttcggagggaatctcggtaaagccatctttcaggccaaaaagagggtcctcgagccctttggtctgattgaacaacccgacaacacggccgggaccggggagaagcgtcccgaacgcgtcgacgactttttcccgaaaaagaagaaggccaagaccgagcaaggcaaagcccctgctcaaacgggcgaagaccccggagaaggaacctcttccaacgctggatcaagcgccccctctagtgtgggatcatctgtcatggctgaaggaggtggcggtccaatgggcgatgcaggccaaggtgccgacggagtgggcaattcctcgggaaattggcattgcgattcccaatggctggacaacggagtcgttacccgaaccactcgaacctgggtcctgcccagctacaacaaccacttgtacaagcggatccaaggaccgggaggaaccgaccccaacaataaattctttggattcagcaccccctgggggtactttgactacaaccgattccactgccacttctccccccgagactggcaacgactcatcaacaacaactggggcatccgacccaaagcgatgcgctttagactctttaacatccaggttaaagaagtcactgtccaagactccaacaccaccatcgccaacaacctcaccagcacggtccaagtctttgcggacaaggactaccagctgccgtacgtcctcggatcggctacagagggcaccttcccgccgttcccagcggatatctacacgatcccgcagtatggttactgcacgctaaactacaacaacgaggcggtggatcgttcggccttctactgtctagactatttcccctcagacatgctgcggacaggaaataactttgaattcacttacacgttcgaggacgttcctttccatagcatgtttgctcacaaccagacgctagaccggctgatgaatcctctcgtcgatcagtacctgtgggctttcagttccgtcagccaaacaggctcgtctggacgggcactcaattattcacgcgcgaccaaaaccaatatggcaacccagtacagaaactggttacctggacccttcgtccgggatcagcaaatctttacgggggctagcaacatcacccaaaacaacgtgttcaacgtttgggataaaggcaagcagtgggtgatagacaatcggatcaatatgatgcagcccggccctgcagcagcgaccacctttagcggagaacccgaccgtcaagccatgcaaaacacgctggcctttagtcggacggtctacgaccagacaaccagtacgaccgatcgtaaccagttgctcattaccaacgaagatgaaatcagacccaccaactcggtcggcatcgacacgtggggagtagttcccaacaacaaccagtccaaggtgaccgccggcactcgcgcggccatcaacaaccaaggggcgcttcccgggatggtgtggcaaaacagagacatttacctccaaggacccatttgggccaaaatccccgacacagacaatcacttccatccgtccccgcttattggcgggtttggctgcaagcatccccctccccagattttcattaaaaacacacccgtcccggccaacccttcggaaacgttccagacggccaaggtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgctgtctccgacaccggatcctattccgaacctcgtcccatcggtacccggtaccttaccaaacctctgtaaattaaacccttcaataaaccgtttatgcgtaactgtacttccgtctcctgtcgttattcagtcacatgatacggcattacctcaccggagtgctggccagtttccaaaacaggctcgctcgctcactcgggccgcgacgccaaaggcgtcgctaccggcccccttggggccggggcccgagtgagcgagcgagcctgttttggaaactggcca

SEQ ID NO: 44 - DNA, 4286 bp, Bat adeno-associated virus
aagaaacctctaatcatcatctgtactttgtgagggtgtggtcgtgagaacgggcatgcccgggcatgtcctgttaatcattaaccagaatggactttggacttaataagttacgtattaatgggtgtgtatataagtaagtgtatttccggactcactcattcgacttccggcggtcgaggagcgaagacgcgaagccatggagttctacagcatcgttctccgcctgcccggcgactttgactcggaggtgccgggcctgcaggacagcttctacaagtggatatccgggccccggcgggagctgccggagtggtcggacctggacccgggtcagatcgagtcggcgtatcagattctcgccgacaagctggtccgcgagtttgcgcagaagtgggccgccttcagcgaggacccgagggcgccgtactttgcgcagctcgagaagggccgggagaacttccacgtgcacgtgctcgcctcctccaagaaggtcgggtcgttcgtggtcggccgctacgtcaggaagatgcgccagcacctcgtcgacgtcgtcttccggaagtgcgagcccgtcgacgccgattggctgcaggtgcaaaagagcgggaaccacaagtccaacgagatcaaggacgagggctttatccccgcctacctgctgccgaagcgccaatcggagctgcagtgggcgtggacgaacatagaaaagtacgagcgcgccacgctgagcgtcgcagagcgcgccagactcgtcgaggagtggaagcggagcctcgccgccgaggaatctgaccccgcggaacccgaacgccgtccgcgaaagtcgaccaaatccgcgtcagaatacatggcgctcgtcaggtggctcgtggacaacggcatcgcgaccgagcgcgagtggatgcgcgaggactcggacgggtacctgagctacaacgccacgggcgccacgcgcgcccagatcaaggccgcgctcgacaacgcggcccgcatcatggtcaacacgaagacggccgccgactacctggtcggcaggaacccgcccctcgacgtggaggacaacaggatctaccggctgtttcgcatgaacggctacgaccccgcctacgcgggcagcgtgctgctcggctggtgccgcaccggcttcggcaagcgcaacaccgtctggctcttcgggccggccacgaccggcaagacgaacctcgccgaggccatcagccactcggtgcccttctacggctgcgtcaactggaccaacgagaacttccccttcaacgactgcgtggacaagatgatcatctggtgggaggagggcaagatgacgtccaaggtcgtcgagagcgccaaggccatcctcggcggcagcaaggtgcgcgtcgaccagaagtgcaagaactcgcagcagatcgagcccacgcccgtcatcatcaccagcaacaccaacatgtgcgaggtcgtcgacgggaactcgaccacgttcgagcaccggcagccgctcgaggacaggatgttcaagttcgagctcaccgtcaggctgcagcccaccttcggcaagatcaccaagcaggaggtgcgcgagttctttaagtgggcggagctcaacgccgtcgacgtggagtacgactttctcgtgcgcaagatcaaccaatcggacactgggggcggggttaagcgcggggcagagcctacaaaggacgagcctcccgcgaagcgcgtgttcttctacggcgcgacttcggagggagaggacgtccgcgagggagccccgggggaatctgactccgtgaacttcgccgagaggtacgtgtcaaaatgctcgaagcacctgtcctggtcaaatatgcgctatccctgccgcgcctgcgagcgcatgaacgcggacgtgaacgtctgcaccccccacggatgcagagactgtcccgagtgctttccccgccccgcccccgtcccgatagccgagcacgacctgtgcctggccccgatcgaggactctgacttttacgtcggctgtatcgacgacgtcaataaagagcaataaaatgatttacagcagtcatgtcgtttgtcgatcaccccccagactggctcgaggagatcggagaggggctctccgagttcatcggactagaggcgggaccgccgaagcctaagccgggctaccaggaccgcgcgcgcggcctcgtcgtccccggctacaagtacctcgggcccttcaacggactcgacaggggcgagcccgtcaacgcggccgacgcggcggccaagaagcacgacgaggagtacgaccggctcctcaaggcgggggacaacccgtacctcgcctacaaccacgcggacgccgagttccagaaggacctcagcggcgactccagcctagccggcaacgccgcgaacgcgctcttccaggccaagaagagggtcctcgagcccttcggactggtcgagggagagccggagcccaagaagacgccttccgtcaagaggccgcacgcatcgccggactcgtcgagcggcgtcgggaagaagggcgaccagcccgcgcggaagaggctcgactttgggacggagcccgcgggtcaagacggagcgggacgagcggcccaggcagccggagatatggcatctgctgaggtggctgcgggtggtggcggaccagtgggcgacgatgcacaaggtgccgatggagtgggtaatgcctcaggaaattggcattacgattccgtttggatggacggcgctgtcatcaccaagtccacccgaacctggagcctgcccgcctacaacaaccacctctaccgccagatccagtccagcggcaccggagacggcacgtactttggttacagcacgccttggggatacttcgatttcaatcgattccactgccacttttctcccagggactggcagcggctcatcaacaaccactggggcatccgccccaagcggctccactttaagctcttcaacatccaggtcaaggaggtcacgacgaccgacggcaccacgaccatcgccaacaacctcaccagcaccatacaggtctttgcggacacggagtaccagctcccgtacgtgctcggcaacgcccacgagggctgcctgccgccgttcccggcggacgtcttcatgctgccgcagtacgcgtacctgacgctcaacgccaaccccacgaaccagggcgcggccgcgctcagcctgccgcagagcgccttctactgcctggagtactttccgagccagatgctgaggaccgggaacaacttctcgttcagctacgagttcgagaagctgcccttccactcgatgttcatgcacagccagagcctggaccggctcatgaacccgctcatcgaccagtacctctggtacctcaacgccacgaccggcaacaacctctccttcaacaaggccggcgccaagaacttccccgagtacttccgcaactggctgcccgggcccggccagcgcgtgcagcagtggagcacgatcggaacccagaacaacgcgcagaccggcacgtgggccagcgccaacaagtggatcctcatgggcaggtccagcaagatggcccccgggctggcccagccggtcaggaacgcccagaccgtcaccaacggctcgcagctcatcttcaacaacgagaccatcaagggctccaccgcgacggcctccaccgtacactcggggctgctcgtcaccaacgagtcggagaccgccccgaccaaccccaactcggcgacaaagtggggcgtcatgacggacaaccagcagaccacctccactacgccgaccgtcagcgacgacctcgaggcgcacgtcttcccgggcatggtctggcaggaccgcgacatctacctgcagggcccgatatgggccaagatcccggagacggacggccacttccacccgtccccgctcatgggcggcttcgggctcaagaacccgccgccgcagatcctcgtcaagaacacgcccgtgcccgccgtgccgcccacgaccttcacaccgcagaaggtcaactccttcatcacgcagtactccaccggccaggtcaccgtcgagatcgagtgggagctgcgcaaggagaagagcaagcgctggaaccccgagatccagtacacctccaacttcgagaactcggccaacgtacagttctccgtcaacggcgacggcgcgtacatcgagccgcgaccgatcggaacccggtacctcacccacaacctgtaaataaatcccccaataaaccgtgtattcgtttcagttgaactttggtctctgcg

SEQ ID NO: 45 - DNA, 4693 bp, Bovine adeno-associated virus
gtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccacactctctagcaagggggttttgtaggtggtgatgtcattgttgatgtcattatagttgtcacgcgatagttaatgattaacagtcatgtgatgtgtgttatccaataggatgaaagcgcgcgaatgagatctcgcgagacttccggggtataaaaggggtgagtgaacgagcccgccgccattctctgctctggactgctagaggaccctcgctgccatggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaaataaagtgagtagtcatgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctagcccaattctgttgcataccctcaataaaccgtgtattcgtttcagtaaaatactgcctcttgtggtcattcggcgtacaacagcttacaacaacaacaaaacccccttgctagagagtgtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgcca

SEQ ID NO: 46 - DNA, 5610 bp, Bovine parvovirus
acttccgggtcacgcccggtagttccgggtcaagtgacgtagttccggtgacgtgtcgctcacggctagggggttgggttacgagtgtcgaaaaaatttacataagaggaacgaatattaatgaggtggcgaaacattgtcctaatatggtgctgaacgctgattggttgtctatataaggtaacacacaacctgattggctagcgtcacatcctgataggaggtatataaagcacaacacggaagtgacagctcattcttctctcagctgtcagagagggaggacgtctcttggtgagtacaaaatgagctactacacttttgttgtaactatacctgataaaattgaagactatggacaagcttactatgatgtagttaacagagtaactttaactcatagagacaatgagaaatgggtatatgacccagaagacagggaaattatttttaaacaggctcaggtatatgttgactgcttagaaagaaggttaaaacagatgttagtgtccggaagtatgtacaattactttatacagctagagcaaggagaaaagcacaagaggtggcacatacacgtagtgttagacataagcgtgggaaatccaagaaactgtagagaagtgatagaaaaggtagaatatgaatacaacagcatttgctacggtagaccagtaagacagactcagattaatagaacaagcaacggtagttggaagatagagactgaagactttattatcaactacttactatgcaaaataccacctaaagaagctaagtatgcctggactaacattaaaaacaagataggagacgcttgtttaaacattgacttaagaaaagaaatttcagttagaccggacatagacgtaccgatgtggagacaagctagcggagacagaatgagagacttggtagaatggtgcataaaaaaccatgtatttacagaagaccaatacatggctaaatttgaagaaagctactacagctttgcatgcactaatcaaggcagacacatgctacaaacaagcttagaattagcagcaaaaaggacgactagcatgataccgctcggcgtttacttagcaggattcagtaacattcaagaagcaattgaagaggctaacaaaacagaatttgcagacatatacaacaacaaagtgtttgacttgctacagtttcaaggctacgacccagtagtagcaggatacattatatacgcttggagcatacgagcgacaggacgtagaggagccttatggttctacggaccaggacaaacaggaaaaagtataatggcaagggctatggctacatgcagcgtccgatacggctgcgtgaactggacaaactctaactttccatttcaagacttagcaacaaactgccaaataggatggtgggaagaaggggtaatcacagaagacattgtggaaagtgctaaagcactactgagcgggggtaaaataagagtagacagaaaatgtagagacagcgtagaaattacaccgccaccatttgtgattactagcaacaacgacatgacattagtgcaaggaggaaatcaagtaagctttgtccacaaaaaaccgctagaagacaggatgattaaatttaacttcaacaagagacttccacctaactttggcatagtagagagagaagacatgaaacaattttttaaatggagcagttttatctactacaacaaactgctaccaaaagaacaggcatacttaagtgatcctaaactgatagggcacgtagtcccatacacaagctttttaagacagactgcaaaagtagagaaaattgtaagaccattcgaggaacaagaacaagaagacttggcagaactagactcttggtttgcggaccccccatacatggggaagcccccaaaaaagagtgagtagctacatatattttgtactcactttgtgtgcgtgacacgtcactgacacacacgattttttgcagaagtacgctttgaggacaaacagttacttccgcaagaagaattagaccacatctgtcacaatcaagagtgctgtcaatacccatcgtgcgcaggatttcaacagtaagtgaaatcttgcattacttattgcgtaacttgccaagggcaacgacttagcaatgcatggtttcccttgcaggccgccgaccacctcttcacacctaccagaactcacagacgaagaagtctgtagcatactagatagtgaagaaggctgggacggggacaactttgcagaacagtaatggccgctaaactgggagggggcttagtaggggaagcagctatacaccgcatagaaagcttatcaggcaaagtacactataaggacaaatactggtttccagacaactacgtatatacaacaggaaaccaagaggaagaagacaaaatagtagcaaaacttttactagatcctaatgcaccagttaaagaatggggaaacggcaggtggtcctttgaatacggaccagaatggcgtagactgggctttataccacacacagatgacattaattaccgcggactctcataccacaaagcacctgggacacagctgctagaaggtatacacgagatacctccagaacagaaacaaggccctgaaagtataacacaaatagcaccacccacacaagactctgtactgttagagcccatgacaaatgacccacactataaaaaaccaaaacctccgggggacttaggagacattccaaagccgctcacaccatggcaactggcaaacaaaatagggccagactatgcaaggcaattattgacgatgtcgggacacgattttactggacgtacacccccagtacaaattcctgaccctggcatccgagaaggcctaaaagaattggaagaacaaagtaaactcatggaaagagtacaagccggtgaaggggacgaaaaacccagaggcggtcttactcttccaaaacacaggtatgtcggacccggaggggacctcccggcagggcgtccaatgtccaaactggatgaaattgctgctcgacatgatattgggtaccacactgaaataaaacataaacataacccttattactggtataacttttacgatgagcaaatggttaaagaaataaatgaaaacatggaccaaatagcagaggaaggggaatcctggctagcaaactttatacttgctacatggaaagccaaagctagctttactaaccctttaggtatattattagaacacttacaaccagattgggctacatactatgacccagcaaacacacatcataaacaatggattgcatttcagcgtgccttaacacagcacgggacagcgtcgacggagcgaccgaggacacctccgaccccggacaacgagatgtttccacacttggctaaacgaccccgactagatgaacctaataaatctgcttcttgctctacagacatgtcgtcctgtgaaatttcttccacacaatgcacaaacgacgaagacatggagctcaaccagactacagtcatggggatgccaagttcaactacagacagcacaatcgggaacactgggatccagggcacaggtgactgtgcgggaggcggggggggagcgcaacgatgtaccaacaaatggttagggggaatatcatggacgcataacacatttaccacataccaaacacgacgatgcatactgcaaccgtttacaaacaaatacacatttacaagcagtgtagatagcacaccaggaattacagtaaccacaccatggtactacatagacttaaactgcttctacagccacattcctccatctacaatgcaagaaataattgaaactacagacggctttaagccgttaacattaacagtaacaattacagaaattgtgggaaaagacgtaagctgcacaactacatcatctggggtgccaaacacagttacagactcacaaacagcaactttgctgctacacagggacgatcactacgaactgccatacgtgattggcggtggacaagaaacagtgcctgagcacttaccaggggactggtacaagctgccacaatactgctacacaaccgtaggcatggaaagtccatggggtaactggtcacaagcgcgaccagatgactgcgcaggaaacacctggtcggttaattgcacaaactactacagtacacaagacagtgaactatttctactagaaaacttagtgaacacacaactgcatccagggtgctcctggacgtcacaataccactttccacacttacctatggcatacactacacaatacccgtggagcacaagacggcaagacaacccatgtcaaaaacaaagaatagtggctgtacgaaactgttgctccacaacaaatacagacgccaacaaacgccaggttatagaggtagaccaggaccaagcagacatgggttttttcagaaagccgacaatgtggttgccggctaacagacacagagacggcgactgccaaatcatccctcccaaaggcagagaataccacgtactaccagttagatcaggactcccaccagtcatagttgtacgacagggaatttttaacccactcccagcaagtggtgtttttggcttaacctcgggaacagaacagccagggccaccgacagaagacaaagcagtcattacgccaggaggcaccacggtgcttacatctaacacactaacggtgaaacgcaaacacaaatacaaaaaccaaaaccacgacgtgcacacagtatacgaaggcaaacaagaacaaaaacgcctgtaccaactggtggtgcagcgagaaaggggagttggaggaccagcagagcccaaccacgtacaagagcgaattataggtagcaccggggaaaaacttccgggcagcagatacccgctacaaagcgaaattacatacgggcaacacacaggggctgtagaagagagtgagtccgggttctacgaatttcaaatctgggagagaaatccaaacacagacctagggaaagggggacacaaaccacccttagctcagtgggctatggaaaagccaccgcctacaatatacctccgaatgcttcctatgccctgtgcgccttgcaaaaacaaatacacaaaaagtccaggaatgaaaggagttataaacagctacattacatttcagctacagtactctatcaaatgggcttatactcctaggacccacaccagaaggtggaaccctaccagtccagcacttcttccaccaccacttcctggttctaccgtcgtgtacaaccttgactcccagaagttcaccaccgacaatcaatacaccatcgcagcagaatcctggcaattcaaaaacagattgagacataacagatgattacgtagttgttgtcatagcttttatgtccatgtacttttatttgatcttgttgtgtattttaaatcaaaatgatttgatttgattttaacttaatttgatttgatttgatttgatttgattgtatcacaaatattcttgtgaaagaaataaagaaaaagaaaacccaagacatccgagtgagctaccacgctggtgtcccgcgcctttggcgcgggacacccag

SEQ ID NO: 47 - DNA, 4467 bp, California sea lion adeno-associated virus
ttatatagcatgactcacatgttacgttgctgttatgtgtcgagcgagcgagcgagccaggagggggattgcccactctctcaaaagggactgaccattcctgactcatgcctgacctttgttcttctagtctgttcttttgctgacacatttcttatatgttacatattaactatggggtgactgcttttatccaatgagacacagggcgttgccctgcacatgggtatatctgtccgaatgagcgagcgctcagtacagagcgtctctgcttgttaacaagatggcttccttctacgaggtggtggccaagatccccagcgacctggaggagcaccttcccggcatctgcgatgactttgtctctgtgattatgagcaaggagtggcgtttgcccgagagctccgaccttgtcctggaccagattgaccagccgaagctgactatcgcggacgccgtccgcaaggtcttttactttgagtggctcaagtactgccgcgacgtggaagagcccttgttctttttccaatttgagaagggcaaggagaactttcacgtccacatggtcatcgagacctccaacgtgagttccatggtcctgggccggtacattggtactattaaaaagaagctggtccgcaaggtgtttcgggaggtcgagccccagatgcccgactggctagccgtgaccaagactaagcaatccgggggcgttaacaagacctacgacaagggctacattcccgcctacctgctacccaagacccaaccggagcttcagtgggcgtggacaaacatcgaagagtataagagcgccagcctgaacctggccgagcgcaaacggctggtggatgagttcctggcttcgcttcgccgcgacggcccgtctcagagcgagcctgacgaccagcagccccacggaccggtcatcagaaaccggaccagtcaaaagtacatggctctcgtgtcctggctcgtggagaatggaatcaccagcgaaaagcagtggatccaggaagaccaggaaagctacctttcatttaatgctgcaggcagctctaggagccagatcaaatcggccctggacaacgccagtcgaatcatgtctctcacaaagaaagcctctgactatctcgttggacagtccgtccccgaagatatcacagaaaataaaatctaccagctgtttaaaatgaacggatatgaccctgcttacctgggctccattttgctgggatggtgccagggcaggtttggcaaaagaaacaccgtctggctgtatggacccgcgacgacgggcaagacgaacctggcggaggcgattgcgcactctgtgccattttatggttgtgtcaattggaccaacgagaactttcccttcaacgactgcgtggacaaaatgctcatctggtgggaagaaggaaagatgacgtccaaggtggtggaatcggccaaggcgatcttgggcggatccaaggtccgcgtggaccaaaagtgcaagagctccgtgcagattgactcgaccccggtgatcatcacttccaataccgacatgtgctgcgtgattgacggcaattcaaccacgttcgagcaccggcagcccctcgaggaccgcatgttccgcatcaacctcgaacagagactctcccatgactttgggaaaattaccaagagggaggtgcgggaattcctagcctgggcgcaggaatatgaagtagacgtagagcataccttcgaggtgactaagctggcgaagccaaaggtcactaaaaggtccgcccctctgtctgatgactataaaagcccggcaaagagagcgcgcctcattcccgatcttgtcgcggaggaggcaacgtcgagcgctctagccgaggccgaggagtgggacctaaactgggaccgaaggtacgactgccgctgtgaggcacactctatgtctgtgcgggtagaggggctgtgtcgggactgtgaatatctgaaccggggaaaaaatatgtgtcttgttcacggggacaccgggtgtcatgtctgtcatgccgtccccccttgggtgtctgatcctgatgattgtactgatgagcaataaaagttcaaaattctaaactgaaatgtagccatgtcttctttgtttaaagagtacctgcagagtaccggactggtgggtatccagtcgggagcgccgaagccaaaggccggccagcagaagcaggatacagggtcctttgagtggaaaaagaaggaggacacagccagagggctggtccttcccggttacaagtacctcgggcccttcaacggtctagagcggggcgagcctgtgaatgccgcggacgccgcggcccagcgacacgaccgacagtacgatcgtattctacaacaagggggtaatccatacctcacgtacaaccacgccgaccgagagttccaggaggagctccagtctgacgagtcttttgggggaaatcttggcaaggctgtgtttcaggccaagaagcgaatcctagagcccctcggtctggttgaagaggatccctctcagccagattcgtcctcggacaacacggcgccacccgtgaaaaagtcccgtctcgaagaagcccagcccattcaaagtccagacgtttccagcagcactggcggaggaattgccgacgtcatgtctggagatgctgaaatggctgcagtgggcgggggagcaccgggcgtcgacggccagggtgccgagggagtgggtacttcctcgggtaattggcattgcgattcccagtggtcagaaggacacgtcagaaccaccagcaccagaacctgggtgttgcccagctacaacaaccacctgtataaacggcttggaagtagcgcacaatccaatacctacaacggattctccaccccctggggatacctcgacttcaatagatggcactgtcacttcagtcctcggaactggcaacgtctcatcaacaacaactggggcatcagaccaaaaagacttaatgttaaattgttcaacatacaagtcaaagaggtcacgacggaaggggggacgacgaccgtcgccaataaccttaccagcacgattcaggtgtttgcggacaacgcgtacgaactcccgtatgttgtcgacgcgggtcacgagggggcattgccgccgttcccaaacgacgtgtttatgattccccaatacggatactgcgggctggtgtctggtcaaagtcaggctcagtcggacttgtgttcgttttattgcctggagtattttccatcccagatgctgagaacaggaaacaattttgaaatgaatttcaggtttgaagacgttccatttcactccatgtacgcccacagccagtctctagacaggctcatgaatcctttaattgatcagtatctgtggagtctaaaacaaacaggaaacccgactggatcaacaacgagagacttaaaatttatcaagaacaaagttcccaattttgcacattatggaaaaaattggcttcctggaccttttattagacaacaggggtggacaacacaaaatattaataatagtgttgttaattttaatgacatgctgggaaaaaattcgacatttactttggacactagatggagttcattagcgcctggtccgtgtatgggggatgacggacgaactccatccaccaccaagttctcaaatgctcagctcatgtttggatctggaacacaacccaccgaaggcggtgaagatgctgtacatattacatccgagtcggaggtcaaggcaaccaacccaactgcaatcgatgaatacggacgagtggccgataatacgcaaaatgcaacaaccgccccaaccacagtgggaaatgctgcaatgggggccatgcctgggatggtgtggcaagatagggatatctatcttcaaggacccatctggggaaaaataccccatacagacggacattttcatccgtctcctctcatgggggggtttggatacagaaaaccccctccgcaaatttttattaaaaacacccccgttcctggaaatccggcaactacattttctccaaatagaataaacaatttcattactcaatactcaacgggacaagtgaccgttactattgactgggagctgcaaaaggaaaactcaaagagatggaacccagaagtacaatttacatcaaattttggcacggtcgattcactaaactgggcaccggacaacgcgggaaactacaaagaaccaagggtggtggggtctcgattccttacgcatatactataatcatacccaagtatgttgcatatcctcaataaaccgtgtattcgtatcagttataactacgtgtctgtctttcatgagtcatcaatcagacgtcccctttgagagagtgggcaatccccctcctggctcgctcgctcgctcgacacataacagcaacgtaacatgtgagtcatgctatataacacccagtcata

SEQ ID NO: 48 - DNA, 4395 bp, California sea lion adeno-associated virus
tatatagcatgactcacatgttacgttgctgttatgtgtcgagcgagcgagcgagcccaggaggcaggagggggattgcccactctctcaaaagggactgaccattcctgactcatgcctgacctttgttcttctagtctgttcttttgctgacacatttcttatatgttacatattaactatggggtgactgcttttatccaatgagacacagggcgttgccctgcacatgggtatatctgtccgaatgagcgagcgctcagtacagagcgtctctgcttgttaacaagatggcttccttctacgaggtggtggccaagatccccagcgacctggaggagcaccttcccggcatctgcgatgactttgtctctgtgattatgagcaaggagtggcgtttgcccgagagctccgaccttgtcctggaccagattgaccagccgaagctgactatcgcggacgccgtccgcaaggtcttttactttgagtggctcaagtactgccgcgacgtggaagagcccttgttctttttccaatttgagaagggcaaggagaactttcacgtccacatggtcatcgagacctccaacgtgagttccatggtcctgggccggtacattggtactattaaaaagaagctggtccgcaaggtgtttcgggaggtcgagccccagatgcccgactggctagccgtgaccaagactaagcaatccgggggcgttaacaagacctacgacaagggctacattcccgcctacctgctacccaagacccaaccggagcttcagtgggcgtggacaaacatcgaagagtataagagcgccagcctgaacctggccgagcgcaaacggctggtggatgagttcctggcttcgcttcgccgcgacggcccgtctcagagcgagcctgacgaccagcagccccacggaccggtcatcagaaaccggaccagtcaaaagtacatggctctcgtgtcctggctcgtggagaatggaatcaccagcgaaaagcagtggatccaggaagaccaggaaagctacctttcatttaatgctgcaggcagctctaggagccagatcaaatcggccctggacaacgccagtcgaatcatgtctctcacaaagaaagcctctgactatctcgttggacagtccgtccccgaagatatcacagaaaataaaatctaccagctgtttaaaatgaacggatatgaccctgcttacctgggctccattttgctgggatggtgccagggcaggtttggcaaaagaaacaccgtctggctgtatggacccgcgacgacgggcaagacgaacctggcggaggcgattgcgcactctgtgccattttatggttgtgtcaattggaccaacgagaactttcccttcaacgactgcgtggacaaaatgctcatctggtgggaagaaggaaagatgacgtccaaggtggtggaatcggccaaggcgatcttgggcggatccaaggtccgcgtggaccaaaagtgcaagagctccgtgcagattgactcgaccccggtgatcatcacttccaataccgacatgtgctgcgtgattgacggcaattcaaccacgttcgagcaccggcagcccctcgaggaccgcatgttccgcatcaacctcgaacagagactctcccatgactttgggaaaattaccaagagggaggtgcgggaattcctagcctgggcgcaggaatatgaagtagacgtagagcataccttcgaggtgactaagctggcgaagccaaaggtcactaaaaggtccgcccctctgtctgatgactataaaagcccggcaaagagagcgcgcctcattcccgatcttgtcgcggaggaggcaacgtcgagcgctctagccgaggccgaggagtgggacctaaactgggaccgaaggtacgactgccgctgtgaggcacactctatgtctgtgcgggtagaggggctgtgtcgggactgtgaatatctgaaccggggaaaaaatatgtgtcttgttcacggggacaccgggtgtcatgtctgtcatgccgtccccccttgggtgtctgatcctgatgattgtactgatgagcaataaaagttcaaaattctaaactgaaatgtagccatgtcttctttgtttaaagagtacctgcagagtaccggactggtgggtatccagtcgggagcgccgaagccaaaggccggccagcagaagcaggatacagggtcctttgagtggaaaaagaaggaggacacagccagagggctggtccttcccggttacaagtacctcgggcccttcaacggtctagagcggggcgagcctgtgaatgccgcggacgccgcggcccagcgacacgaccgacagtacgatcgtattctacaacaagggggtaatccatacctcacgtacaaccacgccgaccgagagttccaggaggagctccagtctgacgagtcttttgggggaaatcttggcaaggctgtgtttcaggccaagaagcgaatcctagagcccctcggtctggttgaagaggatccctctcagccagattcgtcctcggacaacacggcgccacccgtgaaaaagtcccgtctcgaagaagcccagcccattcaaagtccagacgtttccagcagcactggcggaggaattgccgacgtcatgtctggagatgctgaaatggctgcagtgggcgggggagcaccgggcgtcgacggccagggtgccgagggagtgggtacttcctcgggtaattggcattgcgattcccagtggtcagaaggacacgtcagaaccaccagcaccagaacctgggtgttgcccagctacaacaaccacctgtataaacggcttggaagtagcgcacaatccaatacctacaacggattctccaccccctggggatacctcgacttcaatagatggcactgtcacttcagtcctcggaactggcaacgtctcatcaacaacaactggggcatcagaccaaaaagacttaatgttaaattgttcaacatacaagtcaaagaggtcacgacggaaggggggacgacgaccgtcgccaataaccttaccagcacgattcaggtgtttgcggacaacgcgtacgaactcccgtatgttgtcgacgcgggtcacgagggggcattgccgccgttcccaaacgacgtgtttatgattccccaatacggatactgcgggctggtgtctggtcaaagtcagaatcagtcggacttgtgttcgttttattgcctggagtattttccatcccagatgctgagaacaggaaacaattttgaaatgaatttcaggtttgaagacgttccatttcactccatgtacgcccacagccagtctctagacaggctcatgaatcctttaattgatcagtatctgtggagtctaaaacaaacaggaaacccgactggatcaacaacgagagacttaaaatttatcaagaacaaagttcccaattttgcacattatggaaaaaattggcttcctggaccttttattagacaacaggggtggacaacacaaaatattaataatagtgttgttaattttaatgacatgctgggaaaaaattcgacatttactttggacactagatggagttcattagcgcctggtccgtgtatgggggatgacggacgaactccatccaccaccaagttctcaaatgctcagctcatgtttggatctggaacacaacccaccgaaggcggtgaagatgctgtacatattacatccgagtcggaggtcaaggcaaccaacccaactgcaatcgatgaatacggacgagtggccgataatacgcaaaatgcaacaaccgccccaaccacagtgggaaatgctgcaatgggggccatgcctgggatggtgtggcaagatagggatatctatcttcaaggacccatctggggaaaaataccccatacagacggacattttcatccgtctcctctcatgggggggtttggatacagaaaaccccctccgcaaatttttattaaaaacacccccgttcctggaaatccggcaactacattttctccaaatagaataaacaatttcattactcaatactcaacgggacaagtgaccgttactattgactgggagctgcaaaaggaaaactcaaagagatggaacccagaagtacaatttacatcaaattttggcacggtcgattcactaaactgggcaccggacaacgcgggaaactacaaagaaccaagggtggtggggtctcgattccttacgcatatactataatcatacccaagtatgttgcatatcctcaataaaccgtgtattcgtatcagttataactacgtgtctgtctttcatgagtcatcaatcagacgtccctttgagagagtgggcaatc

SEQ ID NO: 49 - DNA, 5106 bp, Goose parvovirus
ctcattggagggttcgttcgttcgaaccagccaatcaggggagggggaagtgacgcaagttccggtcacatgcttccggtgacgcacatccggtgacgtagttccggtcacgtgcttcctgtcacgtgtttccggtcacgtgacttccggtcatgtgacttccggtgacgtgtttccggctgttaggttgaccacgcgcatgccgcgcggtcagcccaatagttaagccggaaacacgtcaccggaagtcacatgaccggaagtcacgtgaccggaaacacgtgacaggaagcacgtgaccggaactacgtcaccggatgtgcgtcaccggaagcatgtgaccggaacttgcgtcacttccccctcccctgattggctggttcgaacgaacgaaccctccaatgagactcaaggacaagaggatattttgcgcgccaggaagtgacgtgcaatgccaccctatataagccaggaaacttccggtttagttcattcgttactctgctctcagagagaacggacctcaggtcggagagatggcactttctaggcctcttcagatttcttctgataaattctatgaagttattattagattatcatcggatattgatcaagatgtccccggtctgtctcttaactttgtagaatggctttctaccggagtttgggagcccacgggcatctggaacatggagcatgtgaatctaccgatggtgaccttggcagagaagatcaagaacattttcatacaaagatggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaagggaaacaaatcaagatccccgattggtttgctattactaaaaccaagaggggaggacagaataagaccgtgactgcagcatacatactgcattaccttattcctaaaaagcaacctgaactgcaatgggcctttaccaatatgcctttattcactgctgctgctctttgtctgcaaaagcggcaagaattgctggatgcatttcaagaaagtgatttggctgcccctttacctgatcctcaagcatcaactgtggcaccgcttatttccaacagagcggcaaagaactatagcaaccttgttgattggctcattgaaatggggataacatctgagaagcaatggctcactgagaaccgagagagctacagaagctttcaagcaacttcttcaaataatagacaagtgaaagctgcactggaaaatgcccgtgctgaaatgttattgacaaagactgcaactgattacctgataggaaaagaccctgtcctggatataactaagaatagggtctatcaaattctgaaaatgaataactacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgtgttaactggactaatgagaactttccttttaatgattgtgttgataaaatgctgatttggtgggaggagggaaaaatgactaataaggttgttgaatctgcaaaagcaattttgggagggtctgctgtccgggtagaccagaaatgtaaaggatctgtttgtattgaacctactcctgtaattattactagtaatactgatatgtgtatgattgttgatggcaactctactacaatggaacatagaataccattagaggagcgtatgtttcaaattgtcctatcacataaattggagccttcttttggaaaaatttctaaaaaagaagtcagagaatttttcaaatgggccaatgacaatctagttcctgttgtgtctgagttcaaagtccgaactaatgaacaaaccaacttgccagagcccgttcctgaacgagcgaacgagccggaggagcctcctaagatctgggctcctcctactagggaggagttagaagagcttttaagagccagcccagaattgttctcatcagtcgctccaattcctgtgactcctcagaactcccctgagcctaagagaagcaggaacaattaccaggtacgctgcgctttgcatacttatgacaattctatggatgtatttgaatgtatggaatgtgagaaagcaaactttcctgaatttcaacctctgggagaaaattattgtgatgaacatgggtggtatgattgtgctatatgtaaagagttgaaaaatgaacttgcagaaattgagcatgtgtttgagcttgatgatgctgaaaatgaacaataaagatgactcaaagcagatatgtctacttttttagattcttttgaagagtggtatgagactgcagccgcctcgtggcggaatctgaaagctggagcccctcagccaaaaccaaaccagcagtctcagtctgtgtctccagacagagaacccgaacgaaaagataataatcggggctttgtacttcctggctataagtatcttgggcctggtaacggcctggataaaggcccacctgtcaataaggcggacagcgtcgcgcttgaacacgacaaggcctatgaccagcagcttaaagcgggagacaacccatatataaaattcaatcacgctgaccaggactttatagatagcctccaagacgaccagtcattcggaggtaatcttggaaaggctgtatttcaggccaaaaaacgtatcttagagccatttggcctagtagaagatcctgtcaacacggcacctgcaaaaaaaaatacagggaagcttactgaccattacccggtagttaagaagcctaaacttaccgaggaagtcagtgcgggaggtggtagcagtgccgtacaagacggaggagccaccgcggagggcaccgaacctgtggcagcatctgaaatggcagagggaggaggcggagctatgggcgactcttcagggggtgccgatggagtgggtaatgcctcgggaaattggcattgcgattcccaatggatgggaaacacagtcatcacaaagaccaccagaacctgggtcctgccaagctacaacaaccacatctacaaagcaattaccagcggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacaaagaccattgcaaacaatctcacctcaacaattcaagtctttacggatgatgagcatcaactcccgtatgtcctgggctcggctacggaaggcaccatgccgccgttcccgtcggatgtctatgccctgccgcagtacgggtactgcacaatgcacaccaaccagaatggagcacggttcaatgaccgtagtgcattctactgcttagagtacttccctagtcagatgctaagaacaggcaacaactttgagttcacatttgactttgaagaagttcctttccatagcatgttcgctcattcacaggacttagacaggctgatgaaccccctagtggatcaatacctctggaatttcaatgaggtagacagcagcagaaatgctcaatttaaaaaggctgtgaaaggggcttatggcaccatgggccgcaattggctgccaggacctaaattcctggatcaaagagttagggcctacacaggaggaacagacaactatgcaaactggaacatctggagtaatgggaacaaggtgaatttgaaagacagacagtatctcctacaacccggacctgtgtcagctacttacacagaaggggaggcttccagccttccagctcaaaatattttagggatagctaaagatccatacagatcaggcagcactacagcaggaataagtgacattatggtcacggaagaacaagaagtagcacctacaaatggagtagggtggaaaccatatggtaggactgtaacgaatgaacaaaacactactacagctcctacaagttcagatctggatgttcttggagctttaccaggaatggtttggcagaacagggatatatatctgcagggacctattggggcaaaaataccgaagactgatggtaaattccatccttctccgaatctcggaggatttggcctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtaacagaacaagcataatgtttgcacctaatgaaactggtggatatgtagaagatagattgattggaaccagatatctaactcaaaatctgtaaattctgtgtaaaaattcaaataaagcacttcctggcgcgcaaaatatcctcttgtccttgagtctcattggagggttcgttcgttcgaaccagccaatcaggggagggggaagtgacgcaagttccggtcacatgcttccggtgacgcacatccggtgacgtagttccggtcacgtgcttcctgtcacgtgtttccggtcacgtgacttccggtcatgtgacttccggtgacgtgtttccggcttaactattgggctgaccgcgcgcatgcgcgtggtcaacctaacagccggaaacacgtcaccggaagtcacatgaccggaagtcacgtgaccggaaacacgtgacaggaagcacgtgaccggaactacgtcaccggatgtgcgtcaccggaagcatgtgaccggaacttgcgtcacttccccctcccctgattggctggttcgaacgaacgaaccctccaatgaga

SEQ ID NO: 50 - DNA, 4980 bp, Goose parvovirus
cttattggagggttcgttcgttcgaaccagccaatcaggggagggggaagtgacgcaagttccagtcacgtgcttccggtgacgcacatccggtgacgtgcttcctgtcacgtgtttccggtcacgtgacttccggtgacgtgtttccggctgttaggttgaccacgcgcatgccgcgcggtcagcccaatagccggaaacacgtcaccggaagtcacgtgaccggaaacacgtgacaggaagcacgtcaccggatgtgcgtcaccggaagcacgtgactggaacttgcgtcacttccccctcccctgattggctggttcgaacgaacgaaccctccaataagactcaaggacaagaagatattttgcgcgccaggaagtgacgtggaatgctgccctatataagccaggaagcttccggtttagttcgttcgttactctgctctcagagagaacggatctcaggtcggagagatggcactttctaggcctcttcagatttcttccgataaattctatgaagttattattagattaccatcggatattgatcaagatgtccccggtctgtctcttaactttgtaggatggctttctaccggagtttgggagcccacgggcatctggaacatggagcatgtgaatctaccgatggtgaccttggcagagaagatcaaaaacattttcatacaaagatggaatcagttcaaccaggacgaaacggacttcttctttcaactggaagaaggcagtgagtacattcgtcttcattgctgtattgcccagggcaatgtacggtcttttgttctcgggagatatatgtctcagataaaagactctatcataagagatgtatatgaagggaaacaaatcaagatccccgattggtttgctattactaaaaccaagaggggaggacaaaataagaccgtgactgcagcatacatactgcattacctgattcctaaaaagcaacctgaactgcagtgggcctttaccaatatgcctttatttactgctgctgctctttgtctgcaaaagcggcaagaattgctggatgcatttcaagagagtgatttggctgcccctttacctgatcctcaagcatcaactgtggcaccgcttatttccaatagagcggcaaagaactatagcaaccttgttgattggctcattgaaatgggcataacatctgagaagcaatggctcactgagaaccgagagagctacagaagctttcaagcaacttcttcaaataatagacaagtgaaagctgcactggagaatgcccgtgctgaaatgctattaacaaagactgcaactgattacctgataggaaaagaccctgtcctggatataactaagaacagggtctatcaaattctgaaaatgaataactacaaccctcaatacataggaagtatcctgtgcggctgggtgaagagagagttcaacaaaaggaacgccatatggctctacggacctgccaccaccgggaagaccaacattgcagaagctattgcccatgctgtacccttctatggctgcgttaactggactaatgagaactttccttttaatgattgtgttgataagatgctgatttggtgggaggagggaaaaatgactaataaggttgttgaatttgcaaaagcaattttgggagggtctgctgtccgggtagaccagaaatgtaaaggatctgtttgtattgaacctactcctgtaattattaccagtaatactgatatgtgtatgattgttgatggcaactctactacaatggaacatagaataccattagaggagcgcatgtttcaaattgtcctatcacataaattggagccttcttttggaaaaatatctaaaaaggaagtcagagaatttttcaaatgggccaacgacaatttagttcctgttgtgtctgagttcaaagtccgaacgaatgaacaaaccaacttgccagagcccgttcctgaacgagcgaacgagccagaggagcctcctaaaatctgggctcctcctactagggaggagttagaagagcttttaagagccagcccagaattgttctcatcagttgctccaattcctgtgactcctcagaactcccctgagcctaagagaagcaggaaaaattaccaggtacgctgtgctttgcatacttatgacaattctatggatgtctttgaatgcatggaatgtgagaaggcaaactttcctgaatttcaacctctgggagaaaattattgtgatgaacatgggtggtatgattgtgctatatgtaaagagttgaaaaatgaacttgcagaaattgagcgtgtgtttgaacttgatgatgctgaaaatgaacaataaagatgactcaaagcagatatgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtccttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggagaaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatggccagtatgcaggatacagtaccccctgggggtactttgatttcaaccgcttccactgccacttctcccctagagactggcagagacttatcaacaaccattggggaatcagacccaagtctcttaaattcaagatcttcaatgttcaagtcaaggaagtcacaacgcaggatcagacaaagaccattgcaaacaatctcacctcaacaattcaagtttttacggatgatgagcatcaactcccgtatgtcctgggctcggctacggaagggaccatgccgccgttcccgtcggatgtctatgccctgccgcagtacgggtactgcacaatgcacaccaaccagaatggagcacggttcaatgaccgtagtgcattctactgcttagagtacttccctagtcagatgctgagaacaggtaacaactttgagttcacatttgactttgaagaagttcctttccacagcatgttcgctcattcacaggacttagacaggcttatgaaccccctagtggatcaatacctctggaatttcaatgaggtagacagcagcagaaatgctcaatttaaaaaagctgtgaaaggggcttatggcaccatgggccgcaattggctgccaggacctaaattcctggatcagagagttagggcctacccaggaggaacagacaattatgcaaactggaacatctggagtaatgggaacaaggtgaatttaaaggacaggcagtatctcctacaacccggacctgtgtcagctactcacacagaaagggaggcttccagcatcccagctcagaatattttagggatagctaaagatccatacagatctggcagcactacagcaggaataagtgatattatggtcacggacgagcaggaagtagcacccacaaatgtagtagggtggaaaccatatggtaggactgtaacgaatgaacaaaacactactacagctcctacaagttcagatctggatgttcttggagctttaccaggaatggtgtggcagaacagagatatatatctgcagggacctatttgggcaaaaataccgaagactgatggcaaattccatccttctccaaatctcggaggatttggcctgcacaatccaccaccacaggtcttcatcaagaatacaccagtacctgcagaccctccagtagaatatgtgcaccagaagtggaactcctacataactcagtactctacgggccagtgtacagtagaaatggtgtgggagctgagaaaagagaattcaaagagatggaacccagaaatccagttcaccagcaatttcagtaacagaactaatatcatgtttgcacctaatgaaactggtggatatgtagaagatagattgattggaaccagatatctaactcaaaatctgtaaattctgtgtaaaaattcaaataaagcacttcctggcgcgcaaaatatcttcttgtccttgagtcttattggagggttcgttcgttcgaaccagccaatcaggggagggggaagtgacgcaagttccagtcacgtgcttccggtgacgcacatccggtgacgtgcttcctgtcacgtgtttccggtcacgtgacttccggtgacgtgtttccggctattgggctgaccgcgcggcatgcgcgtggtcaacctaacagccggaaacacgtcaccggaagtcacgtgaccggaaacacgtgacaggaagcacgtcaccggatgtgcgtcaccggaagcacgtgactggaacttgcgtcacttccccctcccctgattggctggttcgaacgaacgaaccctccaataag

SEQ ID NO: 51 - DNA, 5050 bp, Goose parvovirus
ctcattggagggttcgttcgttcgaaccagccaatcaggggagggggaagtgacgcaagttccggtgacgcacatccggtgacgtagttccggtcacgtgcttcctgtcacgtgtttccggtcacgtgacttccggtcatgtgacttccggtgacgtgtttccggctgttaggttgaccacgcgcatgccgcgcggtcagcccaatagttaagccggaaacacgtcaccggaagtcacatgaccggaagtcacgtgaccggaaacacgtgacaggaagcacgtgaccggaactacgtcaccggatgtgcgtcaccggaacttgcgtcacttccccctcccctgattggctggttcgaacgaacgaaccctccaatgagactcaaggacaagaggatattttgcgcgccaggaagtgacgtgcaatgccaccctatataagccaggaaacttccggtttagttcattcgttactctgctctcagagagaacggacctcaggtcggagagatggcactttctaggcctcttcagatttcttctgataaattctatgaagttatcattagattaccatcggatattgatcaacatgtccccggtctgtctcttaactttgtagaatggctttctaccggagtttgggagcccacgggcatctggaacatggagcatgtgaatctaccgatggtgaccttggcagagaagatcaagaacattttcatacaaagatggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaagggaaacaaatcaagatccccgattggtttgctattactaaaaccaagaggggaggacagaataagaccgtgactgcagcatacatactgcattaccttattcctaaaaagcaacctgaactgcaatgggcctttaccaatatgcctttattcactgctgctgctctttgtctgcaaaagcggcaagaattgctggatgcatttcaagaaagtgatttggctgcccctttacctgatcctcaagcatcaactgtggcaccgcttatttccaacagagcggcaaagaactatagcaaccttgttgattggctcattgaaatggggataacatctgagaagcaatggctcactgagaaccgagagagctacagaagctttcaagcaacttcttcaaataatagacaagtgaaagctgcactggaaaatgcccgtgctgaaatgttattgacaaagactgcaaccgattacctgataggaaaagaccctgtcctggacataactaagaatagggtctatcagattctgaaaatgaataactacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgtgttaactggactaatgagaactttccttttaatgattgtgttgataaaatgctgatttggtgggaggagggaaaaatgactaataaggttgttgaatctgcaaaagcaattttaggagggtctgctgtccgggtagaccagaaatgtaaaggatctgtttgtattgaacctactcctgtaattattactagtaatactgatatgtgtatgattgttgatggcaactctactacaatggaacatagaataccgttagaggagcgtatgtttcaaattgtcctatcacataaattggagccttcttttggaaaaatttctaaaaaagaagtcagagaatttttcaaatgggccaatgataatctagttcctgttgtgtctgagttcaaagtccgaacgaatgaacaaactaacttgccagagcccgttcctgaacgagcgaacgagccggaggagcctcctaagatctgggctcctcctactagggaggagttagaagagcttttaagagccagcccagaattgttctcatcagtcgctccaattcctgtgactcctcagaactcccctgagcctaagagaagcaggaacaattaccaggtacgctgcgctttgcatacttatgacaattctatggatgtatttgaatgtatggaatgtgagaaagcaaactttcctgaatttcaacctctgggagaaaattattgtgatgaacatgggtggtatgattgtgctatatgtaaagagttgaaaaatgaacttgcagaaattgagcatgtgtttgaacttgatgatgctgaaaatgaacaataaagatgactcaaagcagatatgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacaaagaccattgcaaacaatctcacgtcaacaattcaagtctttacggatgacgagcatcaactcccgtatgtcctgggctcggctacagaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagtttacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatccaggcggaacagataattacgcaaactggaacatctggagtaatggaaacaaggttaatttgaaggacaggcagtacctcctgcaacccggacctgtatcagctactcacacaaaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaaattctgtgtaaaaattcaaataaagcacttcctggcgcgcaaaatatcctcttgtccttgagtctcattggagggttcgttcgttcgaaccagccaatcaggggagggggaagtgacgcaagttccggtgacgcacatccggtgacgtagttccggtcacgtgcttcctgtcacgtgtttccggtcacgtgacttccggtcatgtgacttccggtgacgtgtttccggcttaactattgggctgaccgcgcggcatgcgcgtggtcaacctaacagccggaaacacgtcaccggaagtcacatgaccggaagtcacgtgaccggaaacacgtgacaggaagcacgtgaccggaactacgtcaccggatgtgcgtcaccggaacttgcgtcacttccccctcccctgattggctggttcgaacgaacgaaccctccaatgag

SEQ ID NO: 52 - DNA, 5054 bp, Goose parvovirus
ctcattggagggttcgttcgttcgaaccagccaatcaggggggggggaagtgacgcaagttccggtgacgcacatccggtgacgtagttccggtcacgtgcttcctgtcatgtgacttccggtcatgtgacttccggtcatgtgacttccggtgacgtgtttccggctgttatgttgaccacacgcatgccgcgcggtcagcccaatagttaagccggaaacacgtcaccggaagtcacatgaccggaagtcacatgaccggaagtcacatgacaggaagcacgtgaccggaactacgtcaccggatgtgcgtcaccggaacttgcgtcacttcccccccccctgattggctggttcgaacgaacgaaccctccaatgagactcaaggacaagaggatattttgcgcgccaggaagtgacgtgcaatgccaccctatataagccgggaaacttccggtttagttcattcgttactctgctctcagagagaacggacctcaggtcggagagatggcactttctaggcctcttcagatttcttctgataaattctatggagttatcattagattaccatcggatattgatcaagatgtccccggtctgtctcttaactttgtagaatggctttctaccggagtttgggagcccacgggcatctggaacatggagcatgtgaatctaccgatggtgaccttggcagagaagatcaagaacattttcatacaaagatggaatcagttcaaccaggacgaaacggacttcttctttcaactggaagaaggcagtgagtacattcattttcattgctgtattgcccagggcaatgtacggtcttttgttctcgggagatatatgtctcagataaaagactctatcataagagatgtatatgaagggaaacaaatcaagatccccgattggtttgctattactaaaaccaagaggggaggacagaataagaccgtgactgcagcatacataccgcattaccttattcctaaaaagcaacctgaactgcaatgggcctttaccaatatgcctttattcactgctgctgctctttgtctgcaaaagcggcaagaattgctggatgcatttcaagaaagtgatttggctgcccctttacctgatcctcaagcatcaactgtggcaccgcttatttccaacagagcggcaaagaactatagcaaccttgttgattggctcattgaaatggggataacatctgagaagcaatggctcactgagaaccgagagagctacagaagctttcaagcaacttcttcaaataatagacaagtgaaagctgcactggaaaatgcccgtgctgaaatgttattgacaaaaactgcgaccgattacctgataggaaaaggccctgtcctggacataactaagaatagggtctatcagattctgaaaatgaataactacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgtgttaactggactaatgagaactttccttttaatgattgtgttgataaaatgctgatttggtgggaggagggaaaaatgactaataaggttgttgaatctgcaaaagcaattttaggagggtctgctgtccgggtagaccagaaatgtaaaggatctgtttgtactgaacctactcctgtaattattactagtaataccgatatgtgtatgattgttgatggcaactctactacaatggaacatagaataccgttagaggagcgtatgtttcaaattgtcctatcacataaattggagccttcttttggaaaaatttctaaaaaggaagtcagagaatttttcaaatgggccaatgataatctagttcctgttgtgtctgagttcaaagtccgaacgaatgaacaaactaacttgccagagcccgttcctgaacgagcgaacgagccggaggagcctcctaagatctgggctcctcctactagggaggagttagaagagcttttaagagccagcccagaattgttctcatcagtcgctccaattcctgtgactcctcagaactcccctgagcctaaaagaagcaggaacaattaccaggtacgctgcgctttgcatacttatgacaattctatggatgtatttgaatgtatggaatgtgagaaagcaaactttcctgaatttcaacctctgggagaaaattattgtgatgaacatgggtggtatgattgtgctatatgtaaagagttgaaaaatgaacttgcagaaattgagcatgtgtttgaacttgatgatgctgaaaatgaacaataaagatgactcaaagcagatatgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacacttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacagaaggcaccatgccgccgttcccgtcggatgtgtatgccctgccgcagtacgggtattgcacaatgcacaccaaccggaacggtgcacgattcaatgaccggagtgcattctactgcttagaatacttccccagtcagatgctaagaacaggcaacaactttgagtttacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattacgcaaattggaacatctggagtaatggaaacaaggttaatttgaaggacaggcagtacctcctgcaacccggacctgtatcagctactcacacagaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaaaactgtaacgaatgaacaaaacactactacagctcctacaagttcagatctggaggttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcttgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaaattctgtgtaaaaattcaaataaagcacttcctggcgcgcaaaatatcctcttgtccttgagtctcattggagggttcgttcgttcgaaccagccaatcaggggggggggaagtgacgcaagttccggtgacgcacatccggtgacgtagttccggtcacgtgcttcctgtcatgtgacttccggtcatgtgacttccggtcatgtgacttccggtgacgtgtttccggcttaactattgggctgaccgcgcggcatgcgtgtggtcaacataacagccggaaacacgtcaccggaagtcacatgaccggaagtcacatgaccggaagtcacatgacaggaagcacgtgaccggaactacgtcaccggatgtgcgtcaccggaacttgcgtcacttcccccccccctgattggctggttcgaacgaacgaaccctccaatgag

SEQ ID NO: 53 - DNA, 5104 bp, Goose parvovirus
ctcattgtagggttcgttcgttcgccccagccaatcatgggagggggaagtgacgcaagttccggtcacatgcttccggtgacgcacatccggtgacgcagttccggtcacgtgcttcctgtcacgtgtttccggtcacgtgacttccggtcatgtgacttccggtgacgtgtttccggctgttaggttgaccacgcgcatgccgcgcggtcagcccaatgttaagccggaaacacgtcaccggaagtcacatgaccggaagtcacgtgaccggaaacacgtgacaggaagcacgtgaccggaactgcgtcaccggatgtgcgtcaccggaagcatgtgaccggaacttgcgtcacttccccctcccatgattcgctggggcgaacgaacgaaccctacaatgagactcaaggacaagaggatattttgcgcgccaggaagtgacgtgcaatgccactctgtataagccaggaaacttccggtttagttcattcgttactctgctctcagagagaacggacctcaggtcggagagatggcactttctaggcctcttcagatttcttctgataaattctatgaagttattattagattaccatcggatattgatcacgatgtccccggtctgtctcttaactttgtagaatggctttctaccggagtttgggagcccacgggcatctggaacatggagcatgtgaatctaccgatggtgaccttggcagagaagatcaagaacattttcatacaaagatggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatgataagagatgtatatgaagggaagcaaattaagatccccgattggtttgctattactaaaaccaagaggggaggacagaataagaccgtgactgcagcatacatactgcattaccttattcctaaaaagcaacctgaactgcaatgggcctttaccaatatgcctttatttactgctgctgctctttgtctgcaaaagcggcaagaattgctggatgcatttcaagagagtgatttggctgcccctttacctgatcctcaagcatcaactgtggcaccgcttatttccaacagagcgacaaagaactatagcaaccttgttgattggctcattgaaatgggcataacatctgagaagcaatggctcactgagaaccgagagagctacagaagctttcaagcaacttcttcaaataatagacaagtgaaagctgcactggaaaatgcccgtgctgaaatgttattaacaaagactgcaactgattacctgataggaaaagaccctgtcctggacataactaagaatagggtctatcaaattctgaaaatgaataactacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgtgttaactggactaatgagaactttccttttaatgattgtgttgataagatgctgatttggtgggaggagggaaaaatgaccaataaggttgttgaatctgcaaaagcaattttgggagggtctgctgtccgggtagaccagaaatgtaaaggatctgtttgtattgaacctactcctgtaattattactagtaataccgacatgtgtatgattgttgatggcaactctactacaatggaacatagaataccattagaggagcgtatgtttcaaattgtcctatcacataaattggaaccttcttttggaaaaatttctaaaaaagaagtcagagaatttttcaaatgggccaatgacaatctagttcctgttgtgtctgagttcaaagtccgaacgaatgaacaaaccaacttgccagagcccgttcctgaacgagcgaacgagccggaggagcctcctaagatctgggctcctcctactagggaggagttagaagagcttttaagagccagcccagaattgttctcatcagtcgctccaattcctgtgactcctcagaactcccctgagcctaagagaagcaggaacaattaccaggtacgctgcgctttgcatacttatgacaattctatggatgtatttgaatgtatggaatgtgagaaagcaaactttcctgaatttcaacctctgggagaaaattattgtgatgaacatgggtggtatgattgtgctatatgtaaagaattgaaagatgaacttgcagaaattgagcatgtgtttgagcttgatgatgctgaaaatgaacaataaagatgactcaaagcagatatgtctacttttttagattcctttgaagagtggtatgagactgcagccgcctcgtggcggaatctgaaagctggagcccctcagccaaaaccaaaccagcagtctcagtctgtgtctccagacagagaacccgaacgaagagataataatcggggctttgtacttcctggctataagtatcttgggcctggtaacggccttgataaaggcccacctgtcaataatgcggacagcgtcgcgcttgaacacgacaaggcctacgaccagcagcttaaagcgggagacaatccatatataaaattcaatcacgctgaccaggactttatagatagtctccaagacgaccagtcattcggaggtaatcttggaaaggctgtatttcaggccaaaaaacgtatcttagagccatttggcctagtagaagatcctatcaacacggcacctgcaaaaaaaaatacagggaagcttactgaccattacccggtagttaagaagcctaaacttaccgaggaagtcagtgcgggaggtggtagcagtgccgtacaagacggaggagccaccgcggagggcaccgaacctgtggcagcatctgaaatggcagagggaggaggcggagctatgggcgactcttcagggggtgccgatggagtgggcaatgcctcgggaaattggcattgcgattcccaatggatgggaaacacagtcatcacaaagaccaccagaacctgggtcctgccaagctacaacaaccacatctacaaagcaattaccagtggaacctctcaagatgcaaatgtccagtatgcaggatacagtaccccctgggggtactttgatttcaaccgcttccactgccacttctcccctagagactggcagagacttatcaacaaccattggggaatcagacccaaatctcttaaattcaagatcttcaatgtccaagtcaaagaagtcacaacgcaggatcagacaaagaccattgcaaacaatctcacctcaacgattcaagtctttacggatgatgagcatcaactcccgtatgtcctgggctcggctacggaaggcaccatgccgccgttcccgtcggatgtctatgccctgccgcagtacgggtactgcacgatgcacaccaaccagaatggagcacggttcaatgaccgtagtgcattctactgcttagagtacttccctagtcagatgctaagaacaggcaacaactttgagttcacatttgactttgaagaagttcctttccatagcatgttcgctcattcacaggacctagacaggctgatgaaccccctagtggatcaatacctctggaatttcaatgaggtagacagcagcagaaatgctcaatttaaaaaggctgtgaaaggggcttatggcaccatgggccgcaattggctgccaggacctaaattcctggatcgaagagttagggcctacacaggaggaacagacaactatgcaaactggaacatctggagtaatgggaacaaggtgaatttaaaagacaggcagtatctcctacaacccggacctgtgtcagctactcacacagaaggggaggcttccagcattccagctcaaaatattttagggatagctaaagatccatacagatctggcagcactacagcaggaataagtgacattatggtcacggacgaacaagaagtagcacctacaaatggagtagggtggaaaccatatggtaggactgtaacgaatgaacaaaacactattacagctcctacaagctcagatctggaagttcttggagctttaccaggaatggtttggcagaacagggatatatatctgcagggacctatttgggcaaaaataccgaagactgatggcaaattccatccttctccgaatctcggaggatttggcctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtaacagaacaagcataatgtttgcacctaatgaaaccggtggatatgtagaaaaaagattgattggaaccagatatctaactcaaaatctgtaaattctgtgtaaaaattcaaataaagcacttcctggcgcgcaaaatatcctcttgtccttgagtctcattgtagggttcgttcgttcgccccagcgaatcatgggagggggaagtgacgcaagttccggtcacatgcttccggtgacgcacatccggtgacgcagttccggtcacgtgcttcctgtcacgtgtttccggtcacgtgacttccggtcatgtgacttccggtgacgtgtttccggcttaacattgggctgaccgcgcggcatgcgcgtggtcaacctaacagccggaaacacgtcaccggaagtcacatgaccggaagtcacgtgaccggaaacacgtgacaggaagcacgtgaccggaactgcgtcaccggatgtgcgtcaccggaagcatgtgaccggaacttgcgtcacttccccctcccatgattggctggggcgaacgaacgaaccctacaatgag

SEQ ID NO: 54 - DNA, 5106 bp, Goose parvovirus
ctcattggagggttcgttcgttcgaaccagccaatcaggggagggggaagtgacgcaagttccggtcacatgcttccggtgacgcacatccggtgacgtagttccggtcacgtgcttcctgtcacgtgtttccggtcacgtgacttccggtcatgtgacttccggtgacgtgtttccggctgttaggttgaccacgcgcatgccgcgcggtcagcccaatagttaagccggaaacacgtcaccggaagtcacatgaccggaagtcacgtgaccggaaacacgtgacaggaagcacgtgaccggaactacgtcaccggatgtgcgtcaccggaagcatgtgaccggaacttgcgtcacttccccctcccctgattggctggttcgaacgaacgaaccctccaatgagactcaaggacaagaggatattttgcgcgccaggaagtgacgtgcaatgccaccctatataagccaggaaacttccggtttagttcattcgttactctgctctcagagagaacggacctcaggtcggagagatggcactttctaggcctcttcagatttcttctgataaattctatgaagttattattagattatcatcggatattgatcaagatgtccccggtctgtctcttaactttgtagaatggctttctaccggagtttgggagcccacgggcatctggaacatggagcatgtgaatctaccgatggtgaccttggcagagaagatcaagaatatcttcatacaaaggtggaatcagttcaatcaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaaggaaaacaaatcaagatccccgattggtttgctatcactaaaaccaagcggggaggacaaaataagaccgtgactgcagcatacatattgcactacctgatacctaaaaaacaacctgagctgcaatgggcctttaccaatatgccattatttagtccggctgctctttgtctgcaaaagcggcaagaattgctggatgcatttcaagaaagcgatttggccgcccctttacctgatcctcaggcatcaactgtggcaccacttatttccaacagagcggcaaagaactatagcaaccttgttgattggctcattgaaatgggcataacatccgagaagcagtggctcactgagaaccgagagagctacagaagttttcaagcaacttcttcaaataatagacaagtgaaagctgcattggaaaatgcccgtgccgaaatgctattaacaaagactgcaaccgattacctgataggaaaagatcctgtcctggacataactaagaacagggtctatcaaattctgaaaatgaataattacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgcgttaactggactaacgagaactttccttttaatgattgtgtcgataagatgttgatttggtgggaggagggaaagatgactaacaaggttgtagagtctgcgaaagcaattttggggggctctgctgtccgggtagaccagaaatgtaaagggtctgtttgtattgaacctactcctgtaattattaccagtaacactgacatgtgtatgattgttgatggtaactccactacgatggagcatagaataccactagaggagcgtatgtttcaaatcgtactatcacataaattagagccttctttcggaaaaatctcgaaaaaagaagttagagaattctttaaatgggccaatgataacttagttcctgttgtatctgagttcaaagtccgaacgaatgaacaaaccaacttgccagagcccgttcctgaacgagcgaacgagccggaggagcctcctaagatctgggcccctcctactagggaggagttagaagagcttttaagagccagcccggaactgttctcagcagttgctccgattcctgtgactcctgagaactctcccgagcctaagagaagcaggaacaattaccaggtacggtgtgctttgcatacttatgacaattctatggatgtctttgaatgtatggactgcgagacggccaattttccggaatttcaacctctgggggaaaactgttgtgatgaacatgggtggtatgactgtactatctgtaaagaattgaaagatgaacttgcagaaattgagcatgtgtttgagcttgatgatgctgaaaatgaacaataaagatgactcaaaacagatatgtctacttttttagattcattcgaagagtggtatgagactgcagccgcctcgtggcggaatctgaaagctggagcccctcacccaaaaccaaaccagcagactcagtctgtgtctccagccagagaacccgaacgaagagatagtaaccggggctttgtacttcctggctataagtatcttggccctggtaacggccttgataaagggccgcccgttaataaggcggacagcgtcgcgcttgaacacgacaaggcctacgaccaacagcttaaagcgggagacaacccttatataaaattcaatcacgctgaccaggactttatagatagcctccaagacgaccggtcgttcggaggtaacctcggaaaggccgtattccaggccaaaaaacgtatcctagagccattcggtctagtagaagactcgatcaacacggcacccgtcaaaaaaaatacagggaaacttactgaccattacccggtggttaagaagcctaaacttaccgaggaggtcagtgcaggaggtggtaccagtgcagtacaagacggaggagccaccgcggagggtaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaaagctcaatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacagtactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggtagaatacgtacaccagaagtggaattcttacataacccagtactctacgggccagtgtacagtagagatggtgtgggagctgagaaaagagaattcaaagagatggaacccagaaatccagttcaccagtaatttcagtaacagaacaagcataatgtttgcacctaatgaaactggtggatatgtagaagatagattgattggaaccagatatctaactcaaaatctgtaaattctgtgtaaaaattcaaataaagcacttcctggcgcgcaaaatatcctcttgtccttgagtctcattggagggttcgttcgttcgaaccagccaatcaggggagggggaagtgacgcaagttccggtcacatgcttccggtgacgcacatccggtgacgtagttccggtcacgtgcttcctgtcacgtgtttccggtcacgtgacttccggtcatgtgacttccggtgacgtgtttccggcttaactattgggctgaccgcgcgcatgcgcgtggtcaacctaacagccggaaacacgtcaccggaagtcacatgaccggaagtcacgtgaccggaaacacgtgacaggaagcacgtgaccggaactacgtcaccggatgtgcgtcaccggaagcatgtgaccggaacttgcgtcacttccccctcccctgattggctggttcgaacgaacgaaccctccaatgaga

SEQ ID NO: 55 - DNA, 5106 bp, Goose parvovirus
ctcattggagggttcgttcgttcgttcccgcgaatcaggggagggggaagtgacgcaagttccggccacgtgtttccggtgacgcacatccggtgacgtacttcctgtcacgtgcttccggtgatgtgtttcctgtcacgtgacttccggtcatgtgacttccggtgacgtatttccggctgttaggttgaccacgcgcatgccgcgcggtcagcccaatagttaagccggaaatacgtcaccggaagtcacatgaccggaagtcacgtgacaggaaacacatcaccggaagcacgtgacaggaagtacgtcaccggatgtgcgtcaccggaaacacgtggccggaacttgcgtcacttccccctcccctgattggcgggttcgaacgaacgaaccctacaatgagactcaaggacacggggatattttgcgcgccaggaagtgacgttaggggctgccctatataagccagtaagcttccggtttggttcattcgttactctgctctcacagagaacggacctcaggtcggagacatggcactttctaggcctctgcagatttcttctgatagattctatgaagttattattagattaccatcggatattgatcaggatgttcccggtctgtctcttacctttgtagaatggctttctaccggagtttgggagcccacgggcatctggaacatggagcgtgtgaatctaccgatggtgactttggcagagaaaatcaagaatatcttcatacaaaggtggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaaggaaaacaaatcaagatccccgattggtttgctatcactaaaaccaggcggggaggacaaaataagaccgtgactgcagcatacatattgcactacctgatacctaaaaaacaacctgagctgcaatgggcctttaccaatatgccattatttagtccggctgctctttgtctgcaaaagcggcaagaattgctggatgcatttcaagaaaccgatttggccgcccctttacctgatcctcaggcatcaactgtggcaccacttatttccaacagagcggcaaagaactatagcaaccttgttgattggctcattgaaatgggcataacatccgagaagcagtggctcactgagaaccgagagagctacagaagttttcaagcaacttcttcaaataatagacaagtgaaagctgcattggaaaatgcccgtgccgaaatgctattaacaaagactgcaaccgattacctgataggaaaagatcctgtcctggacataactaagaacagggtctatcaaattctgaaaatgaataattacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgcgttaactggactaacgagaactttccttttaatgattgtgtcgataagatgttgatttggtgggaggagggaaagatgactaacaaggttgtagagtctgcgaaagcaattttggggggctctgctgtccgggtagaccagaaatgtaaagggtctgtttgtattgaacctactcctgtaattattaccagtaacactgacatgtgtatgattgttgatggtaactccactacgatggagcatagaataccactagaggagcgtatgtttcaaatcgtactatcacataaattagagccttctttcggaaaaatctcgaaaaaagaagttagagaattctttaaatgggccaatgataacttagttcctgttgtatctgagttcaaagtccgaacgaatgaacaaaccaacttgccagagcccgttcctgaacgagcgaacgagccggaggagcctcctaagatctgggcccctcctactagggaggagttagaagagcttttaagagccagcccgggactgttctcagcagttgctccgattcctgtgactcctgagaactctcccgagcctaagagaagcaggaacaattaccaggtacgatgtgctttgcatacttatgacaattctatggatgtctttgaatgtatggactgcgagacggccaattttccggaatttcaacctctgggggaaaactgttgtgatgaacatgggtggtatgactgtactatctgtaaagaattgaaagatgaacttgcagaaattgagcatgtgtttgagcttgatgatgctgaaaatgaacaataaagatgactcaaaacagatatgtctacttttttagattcattcgaagagtggtatgagactgcagccgcctcgtggcggaatctgaaagctggagcccctcacccaaaaccaaaccagcagactcagtctgtgtctccagccagagaacccgaacgaagagatagtaaccggggctttgtacttcctggctataagtatcttggccctggtaacggccttgataaagggccgcccgttaataaggcggacagcgtcgcgcttgaacacgacaaggcctacgaccaacagcttaaagcgggagacaacccttatataaaattcaatcacgctgaccaggactttatagatagcctccaagacgaccggtcgttcggaggtaacctcggaaaggccgtattccaggccaaaaaacgtatcctagagccattcggtctagtagaagactcgatcaacacggcacccgtcaaaaaaaatacagggaaacttactgaccattacccggtggttaagaagcctaaacttaccgaggaggtcagtgcaggaggtggtaccagtgcagtacaagacggaggagccaccgcggagggtaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtgtatgccctgccgcagtacgggtattgcacaatgcacaccagccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaaagctcaatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacagtactacagctcctacgagttcagatcttgatgttcttggagctttaccaggaatggtttggcagaacagagatatatatctacagggacctatttgggctaaaataccaaagacagatggcaaattccatccttctccgaatctcggaggatttggcctgtacaacccaccaccacaggtcttcatcaagaatacaccggtacctgcagaccctccggtagaatacgtacaccagaagtggaattcttacataacccagtattcttcgggccagtgtacagtagagatggtgtgggagctcagaaaagagaattcaaagcggtggaatccagaaattcagttcaccagcaatttcagtgacagaacaagcataatgtttgcacctaatgaaactggtggatacatagaagatagattgattggaaccagatatctaactcaaaatctgtaatgtctgtaaaaagattcaaataaaacacttcctggcgcgcaaaatatccccgtgtccttgagtctcattgtagggttcgttcgttcgaacccgccaatcaggggagggggaagtgacgcaagttccggccacgtgtttccggtgacgcacatccggtgacgtacttcctgtcacgtgcttccggtgatgtgtttcctgtcacgtgacttccggtcatgtgacttccggtgacgtatttccggcttaactattgggctgaccgcgcggcatgcgcgtggtcaacctaacagccggaaatacgtcaccggaagtcacatgaccggaagtcacgtgacaggaaacacatcaccggaagcacgtgacaggaagtacgtcaccggatgtgcgtcaccggaaacacgtggccggaacttgcgtcacttccccctcccctgattcgcgggaacgaacgaacgaaccctccaatgag

SEQ ID NO: 56 - DNA, 5050 bp, Goose parvovirus
ctcattggagggttcgttcgttcgaaccagccaatcaggggagggggaagtgacgcaagttccggtgacgcacatccggtgacgtagttccggtcacgtgcttcctgtcacgtgtttccggtcacgtgacttccggtcatgtgacttccggtgacgtgtttccggctgttaggttgaccacgcgcatgccgcgcggtcagcccaatagttaagccggaaacacgtcaccggaagtcacatgaccggaagtcacgtgaccggaaacacgtgacaggaagcacgtgaccggaactacgtcaccggatgtgcgtcaccggaacttgcgtcacttccccctcccctgattggctggttcgaacgaacgaaccctccaatgagactcaaggacaagaggatattttgcgcgccaggaagtgacgtgcaatgccaccctatataagccaggaaacttccggtttagttcattcgttactctgctctcagagagaacggacctcaggtcggagagatggcactttctaggcctcttcagatttcttctgataaattctatgaagttatcattagattaccatcggatattgatcaagatgtccccggtctgtctcttaactttgtagaatggctttctaccggagtttgggagcccacgggcatctggaacatggagcatgtgaatctaccgatggtgaccttggcagagaagatcaagaacatcttcatacaaaggtggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaagggaaacaaatcaagatccccgattggtttgctattactaaaaccaagaggggaggacagaataagaccgtgactgcagcatacatactgcattaccttattcctaaaaagcaacctgaactgcaatgggcctttaccaatatgcctttattcactgctgctgctctttgtctgcaaaagcggcaagaattgctggatgcatttcaagaaagtgatttggctgcccctttacctgatcctcaagcatcaactgtggcaccgcttatttccaacagagcggcaaagaactatagcaaccttgttgattggctcattgaaatggggataacatctgagaagcaatggctcactgagaaccgagagagctacagaagctttcaagcaacttcttcaaataatagacaagtgaaagctgcactggaaaatgcccgtgctgaaatgttattgacaaagactgccaccgattacctgataggaaaagaccctgtcctggacataactaagaatagggtctatcagattctgaaaatgaataactacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgtgttaactggactaatgagaactttccttttaatgattgtgttgataaaatgctgatttggtgggaggagggaaaaatgactaataaggttgttgaatctgcaaaagcaattttaggagggtctgctgtccgggtagaccagaaatgtaaaggatctgtttgtattgaacctactcctgtaattattactagtaatactgatatgtgtatgattgttgatggcaactctactacaatggaacatagaataccgttagaggagcgtatgtttcaaatcgtcctatcacataaattggagccttcttttggaaaaatttctaaaaaagaagtcagagaatttttcaaatgggccaatgataatctagttcctgttgtgtctgagttcaaagtccgaacgaatgaacaaactaacttgccagagcccgttcctgaacgagcgaacgagccggaggagcctcctaagatctgggctcctcctactagggaggagttagaagagcttttaagagccagcccagaattgttctcatcagtcgctccaattcctgtgactcctcagaactcccctgagcctaagagaagcaggaacaattaccaggtacgctgcgctttgcatacttatgacaattctatggatgtatttgaatgtatggaatgtgagaaagcaaactttcctgaatttcaacctctgggagaaaattattgtgatgaacatgggtggtatgattgtgctatatgtaaagagttgaaaaatgaacttgcagaaattgagcatgtgtttgaacttgatgatgctgaaaatgaacaataaagatgtctcaaagcagatatgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccttgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaactgataattatgcaaactggaacatctggagtaatggaaacaaggttaatttgaaggacaggcagtacctcctgcaacccggacctgtatcagctactcacacagaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctacagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaaattctgtgtaaaaattcaaataaagcacttcctggcgcgcaaaatatcctcttgtccttgagtctcattggagggttcgttcgttcgaaccagccaatcaggggagggggaagtgacgcaagttccggtgacgcacatccggtgacgtagttccggtcacgtgcttcctgtcacgtgtttccggtcacgtgacttccggtcatgtgacttccggtgacgtgtttccggcttaactattgggctgaccgcgcggcatgcgcgtggtcaacctaacagccggaaacacgtcaccggaagtcacatgaccggaagtcacgtgaccggaaacacgtgacaggaagcacgtgaccggaactacgtcaccggatgtgcgtcaccggaacttgcgtcacttccccctcccctgattggctggttcgaacgaacgaaccctccaatgag

SEQ ID NO: 57 - DNA, 5106 bp, Goose parvovirus
ctcattggagggttcgttcgttcgaaccagccgctcatgctaggcggaagtgacgcaagttccggtgacgcacatccggtgacgcacatccggtgacgtagttccggtcacgtgcttcctgtcacgtgtttccggtcacgtgacttccggtcatgtgacttccggtgacgtgtttccggctgttaggttgaccacgcgcatgccgcgcggtcagcccaatagttaagccggaaatacgtcaccggtagtcacatgaccggaagtcacgtgaccggaaacacgtgacaggaagcacgtgaccggaactacgtcaccggatgtgcgtcaccggatgtgcgtcaccggaacttgcgtcacttccccctcccctgattggctggttcgaacgaacgaaccctccaatgagactcaaggacaagaggatattttgcgcgccaggaagtgacgtgcaatgccaccctatataagccaggaaacttccggtttagttcattcgttactctgctctcagagagaacggacctcaggtcggagagatggcacattctaggcctcttcagatttcttctgataaattctatgaagttatcattagattaccatcggatattgatcaagatgtccccggtctgtctcttaactttgtagaatggctttctaccggagtttgggagcccacgggcatctggaacatggagcatgtgaatctaccgatggtgaccttggcagagaagatcaagaacatcttcatacaaaggtggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaagggaaacaaatcaagatccccgattggtttgctattactaaaaccaagaggggaggacagaataagaccgtgactgcagcatacatactgcattaccttattcctaaaaagcaacctgaactgcaatgggcctttaccaatatgcctttattcactgctgctgctctttgtctgcaaaagcggcaagaattgctggatgcatttcaagaaagtgatttggctgcccctttacctgatcctcaagcatcaactgtggcaccgcttatttccaacagagcggcaaagaactatagcaaccttgttgattggctcattgaaatggggataacatctgagaagcaatggctcactgagaaccgagagagctacagaagctttcaagcaacttcttcaaataatagacaagtgaaagctgcactggaaaatgcccgtgctgaaatgttattgacaaagactgccaccgattacctgataggaaaagaccctgtcctggacataactaagaatagggtctatcagattctgaaaatgaataactacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgtgttaactggactaatgagaactttccttttaatgattgtgttgataaaatgctgatttggtgggaggagggaaaaatgactaataaggttgttgaatctgcaaaagcaattttaggagggtctgctgtccgggtagaccagaaatgtaaaggatctgtttgtattgaacctactcctgtaattattactagtaatactgatatgtgtatgattgttgatggcaactctactacaatggaacatagaataccgttagaggagcgtatgtttcaaatcgtcctatcacataaattggagccttcttttggaaaaatttctaaaaaagaagtcagagaatttttcaaatgggccaatgataatctagttcctgttgtgtctgagttcaaagtccgaacgaatgaacaaactaacttgccagagcccgttcctgaacgagcgaacgagccggaggagcctcctaagatctgggctcctcctactagggaggagttagaagagcttttaagagccagcccagaattgttctcatcagtcgctccaattcctgtgactcctcagaactcccctgagcctaagagaagcaggaacaattaccaggtacgctgcgctttgcatacttatgacaattctatggatgtatttgaatgtatggaatgtgagaaagcaaactttcctgaatttcaacctctaggagaaaattattgtgatgaacatgggtggtatgattgtgctatatgtaaagagttgaaaaatgaacttgcagaaattgagcatgtgtttgagcttgatgatgctgaaaatgaacaataaagatgactcaaagcagatatgtctacttttttagattcttttgaagagtggtatgagactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgcccagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttacggcaccatgggccgcaattggctgccaggacctaaattcctggaccagagagttagggcctatacaggcggaactgataattatgcaaactggaacatctggagtaatggaaacaaggttaatttgaaggacaggcagtacctcctgcaacccggacctgtatcagctactcacacagaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctacagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattgattggaaccagatatctaactcaaaatctgtaaattctgtgtaaaaattcaaataaagcacttcctggcgcgcaaaatatcctcttgtccttgagtctcattggagggttcgttcgttcgaaccagccaatcaggggagggggaagtgacgcaagttccggtgacgcacatccggtgacgcacatccggtgacgtagttccggtcacgtgcttcctgtcacgtgtttccggtcacgtgacttccggtcatgtgacttccggtgacgtgtttccggcttaactattgggctgaccgcgcgcaatgcgcgtggtcaacctaacagccggaaacacgtcaccggaagtcacatgaccggaagtcacgtgaccggaaacacgtgacaggaagcacgtgaccggaactacgtcaccggatgtgcgtcaccggatgtgcgtcaccggaacttgcgtcacttccgcctagcatgagcggctggttcgaacgaacgaaccctccaatgag

SEQ ID NO: 58 - DNA, 5125 bp, Goose parvovirus
ctcattggagggttcgttcgttcgaaccagccaatcaggggagggggaagtgacgcaagttccggtgacgcacatccggtgacgtagttccggtcacgtgcttcctgtcacgtgcttcctgtcacgtgtttccggtcacgtgacttccggtcatgtgactgcccgtaacgtgtttccggctgttaggttgaccacgcgcatgccgcgcggtcagcccaatagttaagtcgggtactgtcactctaagtcacatgaccggaagtcacgtgaccggaaacacgtgacaggaagcacgtgacaggaagcacgtgaccggaactacgtcaccggatgtgcgtcaccggaacttgcgtcacttccccctcccctgattggctggttcgaacgaacgaaccctccaatgagactcaaggacaagaggatattttgcgcgccaggaagtgacgtgcaatgccaccctatataagccaggaaacttccggtttagttcattcgttactctgctctcagagagaacggacctcaggtcggagagatggcactttctatgcctcttctgatttcttctgataaattctatgaagttatcattagattaccatcggatattgatcaagatgtccccggtctgtctcttaactttgtagaatggctttctaccggagtttgggagcccacgggcatctggaacatggagcatgtgaatctaccgatggtgaccttggcagagaagatcaagaacattttcatacaaagatggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaagggaaacaaatcaagatccccgattggtttgctattactaaaaccaagaggggaggacagaataagaccgtgactgcagcatacatactgcattaccttattcctaaaaagcaacctgaactgcaatgggcctttaccaatatgcctttattcactgctgctgctctttgtctgcaaaagcggcaagaattgctggatgcatttcaagaaagtgatttggctgcccctttacctgatcctcaagcatcaactgtggcaccgcttatttccaacagagcggcaaagaattatagcaaccttgttgattggctcattgaaatggggataacatctgagaagcaatggctcactgagaaccgagagagctacagaagctttcaagcaacttcttcaaataatagacaagtgaaagctgcactggaaaatgcccgtgctgaaatgttattgacaaagactgcaaccgattacctgataggaaaagaccctgtcctggacataactaagaatagggtctatcagattctgaaaatgaataactacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgtgttaactggactaatgagaactttccttttaatgattgtgttgataaaatgctgatttggtgggaggagggaaaaatgactaataaggttgttgaatctgcaaaagcaattttaggagggtctgctgtccgggtagaccagaaatgtaaaggatctgtttgtattgaacctactcctgtaattattactagtaatactgatatgtgtatgattgttgatggcaactctactacaatggaacatagaataccgttagaggagcgtatgtttcaaatcgtcctatcacataaattggagccttcttttggaaaaatttctaaaaaagaagtcagagaatttttcaaatgggccaatgataatctagttcctgttgtgtctgagttcaaagtccgaacgaatgaacaaactaacttgccagagcccgttcctgaacgagcgaacgagccggaggagcctcctaagatctgggctcctcctactagggaggagttagaagagcttttaagagccagcccagaattgttctcatcagtcgctccaattcctgtgactcctcagaactcccctgagcctaagagaagcaggaacaattaccaggtacgctgcgctttgcatacttatgacaattctatggatgtatttgaatgtatggaatgtgagaaagcaaactttcctgaatttcaacctctaggagaaaattattgtgatgaacatgggtggtatgattgtgctatatgtaaagagttgaaaaatgaacttgcagaaattgagcatgtgtttgagcttgatgatgctgaaaatgaacaataaagatgactcaaagcagatatgtctacttttttagattcttttgaagagtggtatgagactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaagcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctacaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcaccatgcacaccaaccagaacggtgcacgattcaatgaccggagtgcattctactgcttagaatacttccccagtcagatgctaagaacaggcaacaactttgagttcacgtttgactttgaagaagttcctttccatagcatgttcgctcattcacaggacttagacaggctgatgaaccccttagtggatcagtacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacccggacctgtatcagctactcacacagaagcagaggcttccagcatcccagcccaaaatattttaggtttagctaaagatccatacagatcaggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggcctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattgattggaaccagatatctaactcaaaatctgtaaattctgtgctcaaaattccttaaattctgtgtaaaaattcaaataaagcacttcctggcgcgcaaaatatcctcttgtccttgagtctcattggagggttcgttcgttcgaaccagccaatcaggggagggggaagtgacgcaagttccggtgacgcacatccggtgacgtagttccggtcacgtgcttcctgtcacgtgcttcctgtcacgtgtttccggtcacgtgacttccggtcatgtgactaccgggacgagtttccggcttaactattgggctgaccgcggcatgcgcgtggtcaacctaacagccggaaacacgttacgggcagtcacatgaccggaagtcacgtgaccggaaacacgtgacaggaagcacgtgacaggaagcacgtgaccggaactacgtcaccggatgtgcgtcaccggaacttgcgtcacttccccctcccctgattggctggttcgaacgaacgaaccctccaatgag

SEQ ID NO: 59 - DNA, 5102 bp, Goose parvovirus
tcattgtagggttcgttcgttcgaacccgccaatcaggggagggggaagtgacgcaagttccggccacgtgtttccggtgacgcacatccggtgacgtacttcctgtcacgtgcttccggtgatgtgtttcctgtcacgtgacttccggtcatgtgacttccggtgacgtatttccggctgttaggttgaccgctggcatgggcgcggtcagcccaatggttaagccggaaatacgtcaccggaagtcacatgaccggaagtcacgtgacaggaaacacatcaccggaagcacgtgacaggaagtacgtcaccggatgtgcgtcaccggaaacacgtggccggaacttgcgtcacttccccctcccctgattggcgggttcgaacgaacgaaccctacaatgagactcaaggacacggggatattttgcgcgccaggaagtgacgttaggggctgccctatataagccagtaagcttccggtttggttcattcgttactctgctctcacagagaacggacctcaggtcggagacatggcactttctaggcctctgcagatttcttctgataaattctatgaagttattattagattaccatcggatattgatcaggatgttcccggtctgtctcttacctttgtagaatggctttctaccggagtttgggagcccacgggcatctggaacatggagcgtgtgaatctaccgatggtgactttggcagagaaaatcaagaatatcttcatacaaaggtggaatcagttcaatcaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaaggaaaacaaatcaagatccccgattggtttgctatcactaaaaccaagcggggaggacaaaataagaccgtgactgcagcatacatattgcactacctgatacctaaaaaacaacctgagctgcaatgggcctttaccaatatgccattatttagtccggctgctctttgtctgcaaaagcggcaagaattgctggatgcatttcaagaaagcgatttggccgcccctttacctgatcctcaggcatcaactgtggcaccacttatttccaacagagcggcaaagaactatagcaaccttgttgattggctcattgaaatgggcataacatccgagaagcagtggctcactgagaaccgagagagctacagaagttttcaagcaacttcttcaaataatagacaagtgaaagctgcattggaaaatgcccgtgccgaaatgctattaacaaagactgcaaccgattacctgataggaaaagatcctgtcctggacataactaagaacagggtctatcaaattctgaaaatgaataattacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgcgttaactggactaacgagaactttccttttaatgattgtgtcgataagatgttgatttggtgggaggagggaaagatgactaacaaggttgtagagtctgcgaaagcaattttggggggctctgctgtccgggtagaccagaaatgtaaagggtctgtttgtattgaacctactcctgtaattattaccagtaacactgacatgtgtatgattgttgatggtaactccactacgatggagcatagaataccactagaggagcgtatgtttcaaatcgtactatcacataaattagagccttctttcggaaaaatctcgaaaaaagaagttagagaattctttaaatgggccaatgataacttagttcctgttgtatctgagttcaaagtccgaacgaatgaacaaaccaacttgccagagcccgttcctgaacgagcgaacgagccggaggagcctcctaagatctgggcccctcctactagggaggagttagaagagcttttaagagccagcccggaactgttctcagcagttgctccgattcctgtgactcctgagaactctcccgagcctaagagaagcaggaacaattaccaggtacgatgtgctttgcatacttatgacaattctatggatgtctttgaatgtatggactgcgaggaggccaattttccggaatttcaacctctgggggaaaactgttgtgatgaacatgggtggtatgactgtactatctgtaaagaattgaaagatgaacttgcagaaattgagcatgtgtttgagcttgatgatgctgaaaatgaacaataaagatgactcaaaacagatatgtctacttttttagattcattcgaagagtggtatgagactgcagccgcctcgtggcggaatctgaaagctggagcccctcacccaaaaccaaaccagcagactcagtctgtgtctccagccagagaacccgaacgaagagatagtaaccggggctttgtacttcctggctataagtatcttggccctggtaacggccttgataaagggccgcccgttaataaggcggacagcgtcgcgcttgaacacgacaaggcctacgaccaacagcttaaagcgggagacaacccttatataaaattcaatcacgctgaccaggactttatagatagcctccaagacgaccggtcgttcggaggtaacctcggaaaggccgtattccaggccaaaaaacgtatcctagagccattcggtctagtagaagactcgatcaacacggcacccgtcaaaaaaaatacagggaaacttactgaccattacccggtggttaagaagcctaaacttaccgaggaggtcagtgcaggaggtggtaccagtgcagtacaagacggaggagccaccgcggagggtaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggtagaatacgtacaccagaagtggaattcttacataacccagtattcttcgggccagtgtacagtagagatggtgtgggagctcagaaaagagaattcaaagcggtggaatccagaaattcagttcaccagcaatttcagtgacagaacaagcataatgtttgcacctaatgaaactggtggatacatagaagatagattgattggaaccagatatctaactcaaaatctgtaatgtctgtaaaaagattcaaataaaacacttcctggcgcgcaaaatatccccgtgtccttgagtctcattgtagggttcgttcgttcgaacccgccaatcaggggagggggaagtgacgcaagttccggccacgtgtttccggtgacgcacatccggtgacgtacttcctgtcacgtgcttccggtgatgtgtttcctgtcacgtgacttccggtcatgtgacttccggtgacgtatttccggcttaaccattgggctgaccgcgcgcatgcgcgcggtcaacctaacagccggaaatacgtcaccggaagtcacatgaccggaagtcacgtgacaggaaacacatcaccggaagcacgtgacaggaagtacgtcaccggatgtgcgtcaccggaaacacgtggccggaacttgcgtcacttccccctcccctgattggcgggttcgaacgaacgaaccctacaatga

SEQ ID NO: 60 - DNA, 5046 bp, Goose parvovirus
tcattggagggttcgttcgttcgaaccagccaatcaggggagggggaagtgacgcaagttccggtgacgcacatccggtgacgtagttccggtcacgtgcttcctgtcacgtgtttccggtcacgtgacttccggtcatgtgacttccggtgacgtgtttccggctgttaggttgaccgcgcgcatgcgcgcggtcagcccaatagttaagccggaaacacgtcaccggaagtcacatgaccggaagtcacgtgaccggaaacacgtgacaggaagcacgtgaccggaactacgtcaccggatgtgcgtcaccggaacttgcgtcacttccccctcccctgattggctggttcgaacgaacgaaccctccaatgagactcaaggacaagaggatattttgcgcgccaggaagtgacgtgcaatgccaccctatataagccaggaaacttccggtttagttcattcgttactctgctctcagagagaacggacctcaggtcggagagatggcactttctaggcctcttcagatttcttctgataaattctatgaagttatcattagattaccatcggatattgatcaagatgtccccggtctgtctcttaactttgtagaatggctttctaccggagtttgggagcccacgggcatctggaacatggagcgtgtgaatctaccgatggtgaccttggcagagaagatcaagaacattttcatacaaagatggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaagggaaacaaatcaagatccccgattggtttgctattactaaaaccaagaggggaggacagaataagaccgtgactgcagcatacatactgcattaccttattcctaaaaagcaacctgaactgcaatgggcctttaccaatatgcctttattcactgctgctgctctttgtctgcaaaagcggcaagaattgctggatgcatttcaagaaagtgatttggctgcccctttacctgatcctcaagcatcaactgtggcaccgcttatttccaacagagcggcaaagaactatagcaaccttgttgattggctcattgaaatggggataacatctgagaagcaatggctcactgagaaccgagagagctacagaagctttcaagcaacttcttcaaataatagacaagtgaaagctgcactggaaaatgcccgtgctgaaatgttattgacaaagactgcaaccgattacctgataggaaaagaccctgtcctggacataactaagaatagggtctatcagattctgaaaatgaataactacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgtgttaactggactaatgagaactttccttttaatgattgtgttgataaaatgctgatttggtgggaggagggaaaaatgactaataaggttgttgaatctgcaaaagcaattttaggagggtctgctgtccgggtagaccagaaatgtaaaggatctgtttgtattgaacctactcctgtaattattactagtaatactgatatgtgtatgattgttgatggcaactctactacaatggaacatagaataccgttagaggagcgtatgtttcaaatcgtcctatcacataaattggagccttcttttggaaaaatttctaaaaaagaagtcagagaatttttcaaatgggccaatgataatctagttcctgttgtgtctgagttcaaagtccgaacgaatgaacaaactaacttgccagagcccgttcctgaacgagcgaacgagccggaggagcctcctaagatctgggctcctcctactagggaggagttagaagagcttttaagagccagcccagaattgttctcatcagtcgctccaatacctgtgactcctcagaactcccctgagcctaagagaagcaggaacaattaccaggtacgctgcgctttgcatacttatgacaattctatggatgtatttgaatgtatggaatgtgagaaagcaaactttcctgaatttcaacctctaggagaaaattattgtgatgaacatgggtggtatgattgtgctatatgtaaagagttgaaaaatgaacttgcagaaattgagcatgtgtttgaacttgatgatgctgaaaatgaacaataaagatgactcaaagcagatatgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgttcaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacccggacctgtatcagctactcacacaaaagcagaggcttccagcatcccagcccaaaatatgttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaaattctgtgtaaaaattcaaataaagcacttcctggcgcgcaaaatatcctcttgtccttgagtctcattggagggttcgttcgttcgaaccagccaatcaggggagggggaagtgacgcaagttccggtgacgcacatccggtgacgtagttccggtcacgtgcttcctgtcacgtgtttccggtcacgtgacttccggtcatgtgacttccggtgacgtgtttccggcttaactattgggctgaccgcgcgcatgcgcgcggtcaacctaacagccggaaacacgtcaccggaagtcacatgaccggaagtcacgtgaccggaaacacgtgacaggaagcacgtgaccggaactacgtcaccggatgtgcgtcaccggaacttgcgtcacttccccctcccctgattggctggttcgaacgaacgaaccctccaatga

SEQ ID NO: 61 - DNA, 4101 bp, Goose parvovirus
atggcactttctaggcctctgcagatttcttctgataaattctatgaagttattattagattaccatcggatattgatcaggatgttcccggtctgtctcttacctttgtagaatggctttctaccggagtttgggagcccacgggcatctggaacatggagcgtgtgaatctaccgatggtgactttggcagagaaaatcaagaatatcttcatacaaaggtggaatcagttcaatcaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaaggaaaacaaatcaagatccccgattggtttgctatcactaaaaccaagcggggaggacaaaataagaccgtgactgcagcatacatattgcactacctgatacctaaaaaacaacctgagctgcaatgggcctttaccaatatgccattatttagtccggctgctctttgtctgcaaaagcggcaagaattgctggatgcatttcaagaaagcgatttggccgcccctttacctgatcctcaggcatcaactgtggcaccacttatttccaacagagcggcaaagaactatagcaaccttgttgattggctcattgaaatgggcataacatccgagaagcagtggctcactgagaaccgagagagctacagaagttttcaagcaacttcttcaaataatagacaagtgaaagctgcattggaaaatgcccgtgccgaaatgctattaacaaagactgcaaccgattacctgataggaaaagatcctgtcctggacataactaagaacagggtctatcaaattctgaaaatgaataattacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgcgttaactggactaacgagaactttccttttaatgattgtgtcgataagatgttgatttggtgggaggaggagaagatgactaacaaggttgtagagtctgcgaaagcaattttggggggctctgctgtccgggtagaccagaaatgtaaagggtctgtttgtattgaacctactcctgtaattattaccagtaacactgacatgtgtatgattgttgatggtaactccactacgatggagcatagaataccactagaggagcgtatgtttcaaatcgtactatcacataaattagagccttctttcggaaaaatctcgaaaaaagaagttagagaattctttaaatgggccaatgataacttagttcctgttgtatctgagttcaaagtccgaacgaatgaacaaaccaacttgccagagcccgttcctgaacgagcgaacgagccggaggagcctcctaagatctgggcccctcctactagggaggagttagaagagcttttaagagccagcccggaactgttctcagcagttgctccgattcctgtgactcctgagaactctcccgagcctaagagaagcaggaacaattaccaggtacgatgtgctttgcatacttatgacaattctatggatgtctttgaatgtatggactgcgagacggccaattttccggaatttcaacctctgggggaaaactgttgtgatgaacatgggtggtatgactgtactatctgtaaagaattgaaagatgaacttgcagaaattgagcatgtgtttgagcttgatgatgctgaaaatgaacaataaagatgactcaaaacagatatgtctacttttttagattcattcgaagagtggtatgagactgcagccgcctcgtggcggaatctgaaagctggagcccctcacccaaaaccaaaccagcagactcagtctgtgtctccagccagagaacccgaacgaagagatagtaaccggggctttgtacttcctggctataagtatcttggccctggtaacggccttgataaagggccgcccgttaataaggcggacagcgtcgcgcttgaacacgacaaggcctacgaccaacagcttaaagcgggagacaacccttatataaaattcaatcacgctgaccaggactttatagatagcctccaagacgaccggtcgttcggaggtaacctcggaaaggccgtattccaggccaaaaaacgtatcctagagccattcggtctagtagaagactcgatcaacacggcacccgtcaaaaaaaatacagggaaacttactgaccattacccggtggttaagaagcctaaacttaccgaggaggtcagtgcaggaggtggtaccagtgcagtacaagacggaggagccaccgcggagggtaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtctatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaaagctcaatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggtagaatacgtacaccagaagtggaattcttacataacccagtattcttcgggccagtgtacagtagagatggtgtgggagctcagaaaagagaattcaaagcggtggaatccagaaattcagttcaccagcaatttcagtgacagaacaagcataatgtttgcacctaatgaaactggtggatacatagaagatagattgattggaaccagatatctaactcaaaatctgtaa

SEQ ID NO: 62 - DNA, 4101 bp, Goose parvovirus
atggcactttctaggcctcttcagatttcttctgataaattctatgaagttattattagattaccatcggatattgatcaagatgtccccggtctgtctcttaactttgtagaatggctttctaccggagtttgggagcccacgggcatctggaacatggagcatgtgaatctaccgatggtgaccttggcagagaagatcaagaacattttcatacaaagatggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaagggaagcaaattaagatccccgattggtttgctattactaaaaccaagagcggaggacagaataagaccgtgactgcaacatacatactgcattaccttattcctaaaaagcaacctgaactgcaatgggcctttaccaatatgcctttatttactgctgctgctctttgtctgcaaaagcggcaagaattgctggatgcatttcaagagagtgatttggctgcccctttacctgatcctcaagcatcaactgtggcaccgcttatttccaacagagcggcaaagaactatagcaaccttgttgattggctcattgaaatgggcataacatctgagaagcaatggctcactgagaaccgagagagctacagaagctttcaagcaacttcttcaaataatagacaagtgaaagctgcactggaaaatgcccgtgctgaaatgttattaacaaagactgcaactgattacctgataggaaaagaccctgtcctggacataattaagaatagggtctatcaaattctgaaaatgaataactacaaccctcaatacgtaggaagtatcctgtgcggctgggtgaagagagagttcaacaaaagaaacgccatatggctctacggacctgccaccaccgggaagaccaacattgcagaagctattgcccatgctatacccttctatggctgtgttaactggactaatgagaactttccttttaatgattgtgttgataagatgttgatttggtgggaggagggaaaaatgactaataaggttgttgaatctgcaaaagcaattttgggagggtctgctgtccgggtagaccagaaatgtaaaggatctgtttgtattgaaactactcctgtaattattactagtaatactgacatgtgtatgattgttgatggcaactctactacaatggaacatagaataccattagaggagcgtatgtttcaaattgtcctatcacataaattggaaccttcttttggaaaaatttctaaaaaagaagtcagagaatttttcaaatgggccaatgacaatctagttcctgttgtgtctgagttcaaagtccgaacgaatgaacaaaccaacttgccagagcccgttcctgaacgagcgaacgagccgaaggagcctcctaagatctgggctcctcctactagggaggagttagaagagcttttaagagccagcccagaattgttctcatcagtcgctccaattcctgtgactcctcagaactcccctgagcctaagagaagcaggaacaattaccaggtacgctgcgctttgcatacttatgacaattctatggatgtatttgaatgtatagaatgtgagaaagcaaactttcctgaatttcaacctctgggagaaaattattgtgatgaacatgggtggtatgattgtgctatatgtaaagagttgaaaaatgaacttgcagaaattgagcatgtgtttgagcttgatgatgctgaaaatgaacaataaagatgactcaaagcagatatgtctacttttttagattcttttgaagagtggtatgagactgcagccgcatcttggcggcatctgaaagctggagcccccaagccaaaaccaaaccaacaatctcagtctgtgtctacagacagaaaaccccaacgaaaagacaataataggggctttgtacttcctggctataagtatcttgggcctggtaacggccttgataaagggccacctgtcaataaagcggacagcgtcgcgcttgagcacgataaagcgtacgaccagcagctcaaggcaggagacaacccctatataaaatttaatcacgcagatcaagaatttatagatagcctccaagacgaccggtcgttcggaggcaacctcggaaaagccgtattccaagctaaaaaaagaattctagagcctttaggcctagtagaagaacctgtaaacacggctcctgctaaaaagagtagtggaaaactaacagatcactaccctatagtaaagaagcctaaattatctgaagaaaactctccttcacctagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcatcacaaagaccaccagaacctgtgtcctgccaagctacaacaaccacatctacaaagcgattaccagtggaacctctcaagatgcaaatgtccagtatgcaggatacagtaccccctgggggtacttcgatttcaacagatttcactgccacttctctccaagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtactgcaccatgcacaccaaccagaatggagcacggttcaatgaccgtagtgcattctactgcttagagtacttccctagtcagatgctaagaacaggcaacaactttgagttcacatttgactttgaagaagttcctttccatagcatgttcgctcattcacaggacttagacaggctgatgaaccccctagtggatcaatacctctggaatttcaatgaggtagacagcaacagaaatgctcaatttaaaaaggctgtgaaaggcgcttatggcaccatgggccgcaattggctgccaggacctaaattcctggaccagagagttagggcctatccaggcggaacagataattatgcaagctggaacatctggagtaatggaaacaaggttaatttgaaggacaggcagtacctcctgcaacctggacctgtatcagctactcacacagaagcagaggcttccagcatcccagcccaaaatattttaggtttagctaaagatccatacagatctgggagcactgcagcaggaataagtgatattatggtcacggacgagcaggaagtagcacctacaaacggcgtagggtggaaaccatatggcaagactgtaacgaatgaacaaaacactactagagctcctacgagttcagatcttgatgttcttggagctttaccaggaatggtttggcagaacagagatatatatctacagggtcctatatgggctaaaatacccaaaacagatgggaaatttcatccttctccaaacctgggaggttttggtctccataatccacctccccaggtctttattaaaaatacccctgttcctgcagatcctccactagagtatgtaaatcaaaagtggaattcttacattacacagtattcaacagggcagtgtactgtagaaatggtctgggaactcagaaaagaaaactccaagagatggaaccctgagatccaatttaccagtaactttggaaatagaacaagtactatgtttgctccaagtgagactggaggttatgtagaagataggctgattggtaccagatatttgactcagaatctgtaa

SEQ ID NO: 63 - DNA, 4129 bp, Goose parvovirus
tcggagagatggcactttctaggcctcttcagatttcttctgacaaattctatgaagttatcatcaggctaccctcggatattgatcaagatgtgcctggtttgtctcttaactttgtagaatggctttctacgggggtctgggagcccaccggaatatggaatatggagcatgtgaatctccccatggttactctggcagacaaaatcaagaacattttcatccagagatggaaccaattcaatcaggacgaaacggatttcttctttcaattggaagaaggcagtgagtacatccatctgcattgctgcattgcccaggggaatgtccgatcttttgttctggggagatacatgtctcaaattaaagactcaattctgagagatgtgtatgaagggaaacaggtaaaagtcccggattggttttctataactaaaaccaaacggggagggcaaaataagaccgtgactgctgcttatattctgcattacctgattcctaaaaaacaaccggaattacaatgggcttttaccaatatgccccttttcactgctgctgctttatgcctccaaaagaggcaagagttactggatgcttttcaggaaagtgagatgaatgctgtagtgcaggaggatcaagcttcaactgtagctccccttatttccaacagagcagcaaagacctatagtaatctggttgattggctcattgagatgggtatcacctctgaaaaacagtggctaactgaaaataaagagagctaccggagctttcaggctacatcttcaaacaacagacaagtaaaagcagcacttgaaaatgcccgagcagaaatgctactaacaaaaactgccacagactatttgattggaaaagacccagttctggacattactaaaaatcggatctatcaaattctgaagttgaataactataaccctcaatatgtagggagcatcctatgcggatgggtgaaaagagaattcaacaaaagaaatgccatatggctctacggacctgcgaccaccggaaagaccaacatagccgaggctattgcccatgctgtacccttctatggctgtgttaactggactaatgagaactttcctttcaatgactgcgttgataaaatgcttatatggtgggaggagggaaaaatgaccaataaagtagtggaatccgcaaaagcgatactgggggggtctgctgtacgagttgatcaaaagtgtaaggggtctgtttgtattgaacctactcctgtaataattaccagtaatactgatatgtgcatgattgtggatggaaattctactacaatggaacacagaattcctttggaggaaagaatgttccagattgttctttcccataagctggaaggaaattttggaaaaatttcaaaaaaggaggtaaaagagtttttcaaatgggccaatgataatcttgttccagtagtttctgagttcaaagtccctacgaatgaacaaaccaaacttactgagcccgttcctgaacgagcgaatgagccttccgagcctcctaagatatgggctccacctactagggaggagctagaggagatattaagagcgagccccgagctctttgcttcagttgctcctctgccttccagtccggagagatctcctgagagaaagaaaacccgtcgggactatcaggtacgctgtgctatgcacagtttagataactctatgaatgtttttgaatgcctggagtgtgaaagagctaattttcctgaatttcagagtctgggtgaaaacttttgtaatcaacatgggtggtatgattgtgcattctgtaatgaactgagagatgacatgaatgaaattgaacatgtttttgctattgatgatatggagaatgaacaataaagatgattcaaaatagctatgtctacttttttagagaaatttgaagactggtatgagactgcagccgcatcttggcggcatttgaaagctggagcccccaagccaaaatcaaaccaacaatctcagtctgtgtctacagacagaaaaccccaacgaaaagacaataataggggctttgtacttcctggctataagtatcttgggcctggtaacggccttgataaagggccacctgtcaataaagcggacagcgtcgcgcttgagcacgataaagcgtacgaccagcagctcaaggcaggagacaacccctatataaaatttaatcacgcagatcaagaatttatagataatctgcaaggtgatacctcctttggaggcaacctcggaaaagccgtattccaagctaaaaaaagaattctagagcctttaggcctagtagaagaacctgtaaacacggctcctgctaaaaagagtagtggaaaactaacagatcactaccctatagtaaagaagcctaaattatctgaagaaaactctccttcacctagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaacagattccactgccacttctctccaagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacagaaggcaccatgccgccgttcccgtcggatgtctatgccctgccgcagtacgggtactgcaccatgcacaccaaccagaatggagcacggttcaatgaccgtagtgcattctactgcttagagtacttccctagtcagatgctaagaacaggcaacaactttgagttcacatttgactttgaagaagttcctttccatagcatgttcgctcattcacaggacttagacaggctgatgaaccccctagtggatcaatacctctggaatttcaatgaggtagacagcaacagaaatgctcaatttaaaaaggctgtgaaaggcgcttatggcaccatgggccgcaattggctgccaggacctaaattcctggaccagagagttagggcctatccaggcggaacagataattatgcaaactggaacatctggagtaatggaaacaaggttaatttgaaggacaggcagtacctcctgcaacctggacctgtatcagctactcacacagaagcagaggcttccagcatcccagcccaaaatattttaggtttagctaaagatccatacagatctggcagcactgcagcaggaataagtgatattatggtcacggacgagcaggaagtagcacctacaaacggcgtagggtggaaaccatatggcaagactgtaacgaatgaacaaaacactactagagctcctacgagttcagatcttgatgttcttggagctttaccaggaatggtttggcagaacagagatatatatctacagggtcctatatgggctaaaatacccaaaacagatgggaaatttcatccttctccaaacctgggaggttttggtctccataatccacctccccaggtctttattaaaaatactcctgttcctgcagatcctccactagagtatgtaaatcagaagtggaattcttacattacacagtattcaacagggcagtgtactgtagaaatggtctgggaactcagaaaagaaaactccaagagatggaaccctgagatccaatttaccagtaactttggaaatagaacaagtactatgtttgctccaagtgagactggaggctatgtagaagataggctgattggtaccagatatttgactcagaatctgtaaattctgtgtaaaaattcaaa

SEQ ID NO: 64 - DNA, 4126 bp, Goose parvovirus
gagagatggcactttctaggcctcttcagatttcttctgacaaattctatgaagttatcatcaggctaccctcggatattgatcaagatgtgcctggtttgtctcttaactttgtagaatggctttctacgggggtctgggagcccaccggaatatggaatatggagcatgtgaatctccccatggttactctggcagacaaaatcaagaacattttcatccagagatggaaccaattcaatcaggacgaaacggatttcttctttcaattggaagaaggcagtgagtacatccatctgcattgctgcattgcccaggggaatgtccgatcttttgttctggggagatacatgtctcaaattaaagactcaattctgagagatgtgtatgaagggaaacaggtaaaaatcccggattggttttctataactaaaaccaaacggggagggcaaaataagaccgtgactgctgcttatattctgcattacctgattcctaaaaaacaaccggaattacaatgggcttttaccaatatgccccttttcactgctgctgctttatgcctccaaaagaggcaagagttactggatgcttttcaggaaagtgagatgaatgctgtagtgcaggaggatcaagcttcaactgtagctccccttatttccaacagagcagcaaagaactatagcaatctggttgattggctcattgagatgggtatcacctctgaaaaacagtggctaactgaaaataaagagagctaccggagctttcaggctacatcttcaaacaacagacaagtaaaagcagcacttgaaaatgcccgagcagaaatgctactaacaaaaactgccacagactatttgattggaaaagacccagttctggacattactaaaaatcggatctatcaaattctgaagttgaataactataaccctcaatatgtagggagcatcctatgcggatgggtgaaaagagaattcaacaaaagaaatgccatatggctctacggacctgtgaccaccggaaagaccaacatagccgaggctattgcccatgctgtacccttctatggctgtgttaactggactaatgagaactttcctttcaatgattgtgttgataaaatgcttatatggtgggaggagggaaaaatgaccaataaagtagtggaatccgcaaaagcgatactgggggggtctgctgtacgagttgatcaaaagtgtaaggggtctgtttgtattgaacctactcctgtaataattaccagtaatactgatatgtgcatgattgtggatggaaattctactacaatggaacacagaattcctttggaggaaagaatgttccagattgttctttcccataagctggaaggaaatcttggaaaaatttcaaaaaaggaggtaaaagagtttttcaaatgggccaatgataatcttgttccagtagtttctgagttcaaagtccctacgaatgaacaaaccaaacttactgagcccgttcctgaacgagcgaatgagccttccgagcctcctaagatatgggctccacctactagggaggagctagaggagatattaagagcgagccccgagctctttgcttcagttgctcctctgccttccagtccggagagatctcctgagagaaagaaaacccgtcgggactatcaggtacgctgtgctatgcacagtttagataactctatgaatgtttttgaatgcctggagtgtgaaagagctaattttcctgaatttcagagtctgggtgaaaacttttgtaatcaacatgggtggtatgattgtgcattctgtaatgaactgagagatgaacatgaagaaattgaacatgttttcgctattgatgatatggagaatgaacaataaagatgattcaaaatagctatgtctaattttttagagaaatttgaagactggtatgagactgcagccgcatcttggcggcatttgaaagctggagcccccaagccaaaatcaaaccaacaatctcagtctgtgtctacagacagaaaaccccgacgaaaagacaataataggggctttgtacttcctggctataagtatcttgggcctggtaacggccttgataaagggccacctgtcaataaagcggacagcgtcgcgcttgagcacgataaagcgtacgaccagcagctcaaggcaggagacaacccctatataaaatttaatcacgcggatcaagaatttatagataatctgcaaggtgatacctcctttggaggcaacctcggaaaagccgtattccaagctaaaaaaagaattctagagcctttaggcctagtagaagaacctgtaaacacggctcctgctaaaaagagtagtggaaaactaacagatcactaccctatagtaaagaagcctaaattatctgaagaaaactctccttcacctagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaacagattccactgccacttctctccaagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacagaaggcaccatgccgccgttcccgtcggatgtctatgccctgccgcagtacgggtactgcaccatgcacaccaaccagaatggagcacggttcaatgaccgtagtgcattctactgcttagagtacttccctagtcagatgctaagagcaggcaacaactttgagttcacatttgactttgaagaagttcctttccatagcatgttcgctcattcacaggacttagacaggctgatgaaccccctagtggatcaatacctctggaatttcaatgaggtagacagcaacagaaatgctcaatttaaaaaggctgtgaaaggcgcttatggcaccatgggccgcaattggctgccaggacctaaattcctggaccagagagttagggcctatccagccggaacagataattatgcaaactggaacatctggagtaatggaaacaaggttaatttgaaggacaggcagtacctcctgcaacctggacctgtatcagctactcacacagaagcagaggcttccagcatcccagcccaaaatattttaggtttagctaaagatccatacagatctggcagcactgcagcaggaataagtgatattatggtcacggacgagcaggaagtagcacctacaaacggcgtagggtggaaaccatatggcaagactgtaacgaatgaacaaaacactactagagctcctacgagttcagatcttgatgttcttggagctttaccaggaatggtttggcagaacagagatatatatctacagggtcctatatgggctaaaatacccaaaacagatgggaaatttcatccttctccaaacctgggaggttttggtctccataatccacctccccaggtctttattaaaaatactcctgttcctgcagatcctccactagagtatgtaaatcagaagtggaattcttacattacacagtattcaacagggcagtgtactgtagaaatggtctgggaactcagaaaagaaaactccaagagatggaaccctgagatccaatttaccagtaactttggaaatagaacaagtactatgtttgctccaagtgagactggaggctatgtagaagataggctgattggtaccagatatttgactcagaatctgtaaattctgtgtaaaaattcaaa

SEQ ID NO: 65 - DNA, 2523 bp, Mouse adeno-associated virus
tttaagtgggcggagctgaatccagtcccgccccctcacgtgttcagagtgcctcgggtcaatgacgctgggtataaaaggccagagactcccgctcggtcgtcatacgcgacggagagaccgagcggagaggagccttctgccaaacgcccgaggtacgaacacaaaccagtggacaatgggagggaggagaaatgtacgctggactcgtggttggaggggaaccccactcccgctcccatggtcgtgcacgacttgatggactcgagtggttctgtatttgatatgacggttcgggagtgtcccgattcaaataaagagcaatgatttactcaaagtagtcatgtctttctttgattggttaggtaaacagtacgctcaaggagctgctgaattctgggatttgaagtccggtcctcctgcaccaaaaaaggcgcgaaaggacggatcagccggattcaatttccctgggcacaaatacctgggtcctggcaattcattggatcgcggagatcccgtggacgctgacgacgccgctgctcaaaagcacgaccagtcgtaccaagagcagcttgaggcgggagacaatccctacctcaagtacaaccacgccgaccgcgagttccaggaggcgttgaaggacgacacctcctttgaaggaaatctcgcgagaggactctttgaggccaagaagctcgtggcagagcctcttggtctcgtggaaccagaactggcgccacccagtggccgtaaacgaccggtgcaatcgagtcaagagtctggttactcgagtagccaagacaagcggcccaacctcgacgtagacgaggaggaccgtgagttcgctgccgctgcagcggagaccgaaactggaagcgctccccccaccggcaatttgggacctggtacgatggctggaggcggtagcgcgccaatcgacgacggctcgtatggtgccgatggagtgggcaatgcctcgggagattggcattgcgattccacatggctggacaactgtgtcatcacccgaaccactcggacctggaatctgccaacctacaacaaccacatctacaaacgactcaacggaacgacctccggagaccaaagctacttcggattcagcaccccctggggatactttgacttcaaccgcttccactgtcatttctcccctcgagactggcaaagactcatcaacaataactggggactccgaccaaagagcctacggttcaaaatctttaacattcaagttaaagaagtcacgacgcaagactcaacgaagatcatctccaataaccttaccagcacggttcaggtatttgcggacacggagtaccagctcccgtacgtgattggatcggctcacgaaggatgtctgcctcctttcccggctgacgtgttcatgctgccgcagtatggatactgtactcgacaagacggaaacagcaacaatccgaccccgagaagcgccttctattgtttggagtactttcccagcaagatgctaagaactgggaacagttttgaatttacatataactttgagaaggtgccgttccacagcatgtgggctcacaaccagagtctggatcgattgatgaatccattgattgatcagtacctgtactaccttgatgtcacttcgagtaccgggtttacctatcaaaaaggagttcacacgaacttgcccgaacaagagcgcaactggctgccgggaccaggaattcgaaatcaagcttggtttaattctgcaactggaaacaacccactaactggtacctggcaatattccaacaaatacgtacttgaaaaccgtgcttcgaagattgctcctggacctgccatgggaattgaatcaacaaaattcgacgggaacggaatcatcttttctaaagaatacatcaccaatgtaaatacagccaatccgaatcaagtaaacatcacacgcgagaccgaaataaactcaacgaaccccttggctggaggatctctcggagcccacgctaataattcacaaaacacaacaacggcaccgacgctagaccacaccaacgtcatgggtgtgtttccgggtagtgtctggcaagacagagacatttaccttcaaggacaaatctgggccaagattccccacacagacggacatttccacccttctcctctcatgggaggatttggactgaagaacccgcctcctcaaattctgatcaaaaacacacctgttccggctgacccaccaactgaattcaatgcgaacaaaatctcttctttcatcactcaatactcaaccggacaagttacagtggaaatggaatgggaacttcagaaagaaacctccaaaagatggaatccagaaatccagtacagcgacgactcgtcttcgacgtctggctccattctgcactttgctccggatgatgttggaaactacaaagagttccgctctatcggaactcgttaccttacccgtcctctgtaaacctttcctccttgtgtgtaaatacttccttcaataaa

SEQ ID NO: 66 - DNA, 5132 bp, Barbarie duck parvovirus
ctcattggagggttcgttcgttcgaaccagccaatcaggggaggggggaagtgacgtaagttccggtcacgtgcttccggtcacgtgcttccggtcatgtgacttccggtcatgtgacttccggtgacgtgtctcctgtcacgtgacttccggtgacgcacttcctttgatgacgtatttccggttgtcaaggctgatcgggcgcatgcgcccgatctgccatgaaaattaaaccggaaatacgtcatcaaaggaagtgcgtcaccggaagtcacgtgacaggagacacgtcaccggaagtcacatgaccggaagtcacatgaccggaagcacgtgaccggaagcacgtgaccggaacttacgtcacttcccccctcccctgattggctggttcgaacgaacgaaccctccaatgagactcaaggacagcaggactttttgcgcgccaggaaatggtgcaatctaggagagtgtataaggagagctttttccggttgcattcattcgttgctctgctctcacagagaacggacctcaggtcaggaaaatggcattttctaggcctcttcagatttcttctgacaaattctatgaagttatcatcaggctaccctcggatattgatcaagatgtgcctggtttgtctcttaactttgtagaatggctttctacgggggtctgggagcccaccggaatatggaatatggagcatgtgaatctccccatggttactctggcagacaaaatcaagaacattttcatccagagatggaaccaattcaatcaggacgaaacggatttcttctttcaattggaagaaggcagtgagtacatccatctgcattgctgtattgcccaggggaatgtccgatcttttgttctggggagatacatgtctcaaattaaagactcaattctgagagatgtgtatgaagggaaacaggtaaaaatcccggattggttttctataactaaaaccaaacggggagggcaaaataagaccgtgactgctgcttatattctgcattacctgattcctaaaaaacaaccggaattacaatgggcttttaccaatatgccccttttcactgctgctgctttatgcctccaaaagaggcaagagttactggatgcttttcaggaaagtgagatgaatgctgtagtgcaggaggatcaagcttcaactgcagctccccttatttccaacagagcagcaaagaactatagcaatctggttgattggctcattgagatgggtatcacctctgaaaaacagtggctaactgaaaataaagagagctaccggagctttcaggctacatcttcaaacaacagacaagtaaaagcagcacttgaaaatgcccgagcagaaatgctactaacaaaaactgccacagactatttgattggaaaagacccagttctggacattactaaaaatcggatctatcaaattctgaagttgaataactataaccctcaatatgtagggagcgtcctatgcggatgggtgaaaagagaattcaacaaaagaaatgccatatggctctacggacctgcgaccaccggaaagaccaacatagccgaggctattgcccatgctgtacccttctatggctgtgttaactggactaatgagaacttcccatttaatgactgcgttgataaaatgcttatatggtgggaggagggaaaaatgaccaataaagtagtggaatccgcaaaagcgatactgggggggtctgctgtacgagttgatcaaaagtgtaaggggtctgtttgtattgaacctactcctgtaataattaccagtaatactgatatgtgcatgattgtggatggaaattctactacaatggaacacagaattcctttggaggaaagaatgttccagattgttctttcccataagctggaaggaaattttggaaaaatttcaaaaaaggaggtaaaagagtttttcaaatgggccaatgataatcttgttccagtagtttctgagttcaaagtccctacgaatgaacaaaccaaacttactgagcccgttcctgaacgagcgaatgagccttccgagcctcctaagatatgggctccacctactagggaggagctagaggagatattaagagcgagccctgagctctttgcttcagttgctcctctgccttccagtccggacacatctcctaagagaaagaaaacccgtggggagtatcaggtacgctgtgctatgcacagtttagataactctatgaatgtttttgaatgcctggagtgtgaaagagctaattttcctgaatttcagagtctgggtgaaaacttttgtaatcaacatgggtggtatgattgtgcattctgtaatgaactgaaagatgacatgaatgaaattgaacatgtttttgctattgatgatatggagaatgaacaataaaggtgattcaaaatagctatgtctacttttttagagaaatttgaagactggtatgagactgcagccgcatcttggcggcatttgaaagctggagcccccaagccaaaatcaaaccagcaatctcagtctgtgtctacagacagaaaaccccaacgaaaagacaataataggggctttgtacttcctggctataagtatgttgggcctggtaacggccttgataaagggccacctgtcaataaagcggacagcgtcgcgcttgagcacgataaagcgtacgaccagcagctcaaggcaggagacaacccctatataaaatttaagcacgcagatcaagaatttatagataatctgcaaggtgatacctcctttggaggcaacctcggaaaagccgtattccaagctaaaaaaagaattctagagcctttaggcctagtagaagaacctgtaaacatggctcctgctaaaaagagtagtggaaaactaacagatcacgaccctatagtaaagaagcctaaattatctgaagaaaactctccttcacctagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcattaccaagactacaagaacctgggtcctgccaagctacaacaaccacatgtaccaagccatcacaagcggaacaaacccagactcaaatacccaatatgctggatacagcaccccctgggggtactttgatttcaacagattccactgccatttctctccaagagactggcagagactcatcaacaaccattgggggattagaccgaaagcactcaaattcaagatattcaatgtgcaagttaaagaagtcacgacgcaagaccagacaaagactattgctaacaaccttacctctacaatccagatattcacggataatgaacaccagctgccctatgttctgggctcggccacggaggggacgatgccaccgttcccctcagatgtgtatgccttgccccagtacggctactgcacaatgcacaccaaccagagtggagcgagattcaatgacagaagtgccttctattgcttagagtacttccccagtcagatgctgagaacagggaataattttgaattcagttttgagtttgaagaagttcccttccatagcatgttcgctcattcacaggatttagacaggctaatgaatcctctcctagatcagtacctgtggaatttctctgaggttaatggtggcaggaatgcacagttcaaaaaagctgtgaaaggagcatttggtgcaatggggagaaattggcttccaggacccaaacttctagaccaaagggtaagagcatacagtggaggaacagataactatgcgaactggtcaatctggagtaaaggaaacaaagtttttcttaaagacagagagtatctcctgcaaccaggtccagtagctactacacatacagaagatcaggcttccagtgtaccggctcaaaacataataggaattgcaaaagacccctacaggtcaggcagtactctggcaggaatttcagacatcatggtaacagatgagcaagaaatagcaccaactaacggtgtagggtggagaccttatggattgaccgtaaccaatgaacaaaacacaacaacagctcctacaaatgctgagctagaagtactgggagcactacctggcatggtctggcagaacagagatatttacctgcagggtcctatatgggctaaaatacccaaaacagatgggaaaccccatccttctccaaacctgggaggttttggtctccataatccacctccccaggtctttattaaaaatactcctgttcctgcagatcctccactagagtatgtaaatcagaagtggaattcttacattacacagtattcaacagggcagtgtactgtagaaatggtctgggaactcagaaaagaaaactccaagagatggaaccctgagatccaatttaccagtaactttggaaatagaacaagtactatgtttgctccaaatgagactggaggctatgtagaagataggctgattggtaccaggtatttgactcagaatctgtaaatttctgtattcttttgattttaaataaaccatttcctggcgcgcaaaaagtcctgctgtccttgagtctcattggagggttcgttcgttcgaaccagccaatcaggggaggggggaagtgacgtaagttccggtcacgtgcttccggtcacgtgcttccggtcatgtgacttccggtcatgtgacttccggtgacgtgtctcctgtcacgtgacttccggtgacgcacttcctttgatgacgtatttccggttgtcaaggctgatcgggcgcatgcgcccgatctgccatgaaaattaaaccggaaatacgtcatcaaaggaagtgcgtcaccggaagtcacgtgacaggagacacgtcaccggaagtcacatgaccggaagtcacatgaccggaagcacgtgaccggaagcacgtgaccggaacttacgtcacttcccccctcccctgattggctggttcgaacgaacgaaccctccaatga

SEQ ID NO: 67 - DNA, 4265 bp, Muscovy duck parvovirus
tttccggttgcattcattcgttgctctgctctcacagagaacggacctcaggtcaggaaaatggcattttccaggcctcttcagatttcttctgacaaattctatgaagttatcatcaggttaccctcggatattgatcaagatgtgcctggtttgtctcttaactttgtagaatggctttctacgggggtctgggagcccaccggaatatggaatatggaacatgtgaatctccccatggttactctggcagacaaaatcaagaacattttcatccagagatggaaccaattcaatcaggacgaaacggatttcttctttcagttggaagaaggcagtgagtacatccatctgcattgctgtattgctcaggggaatgtccgatcttttgttctggggagatacatgtctcaaattaaagactcaattctgagagatgtctatgaggggaaacaggtaaaaataccggattggttttctataactaaaaccaaacggggagggcaaaataagactgtgactgctgcttatattctgcattacctgattcctaaaaaacaaccagaattacaatgggcttttaccaatatgccccttttcactgctgctgctttatgcctccaaaagaggcaagagttactggatgcttttcaggaaagtgagatgaatgctgtagtgcaggaggatcaagcttcaactgtagctccccttatttccaacagagcagcaaagaactatagcaatctggttgattggctcattgagatgggtatcacctctgaaaaacagtggctaactgaaaataaagagagctaccggagctttcaggctacatcttcaaacaacagacaagtaaaagcagcacttgaaaatgcccgagcagaaatgctactaacaaaaactgccacagactatttgattggaaaagacccagttctggacattactaaaaatcggatctatcaaattctgaagttcaataactataaccctcaatatgtagggagcatcttatgcggatgggtgaaaagagaattcaacaaaagaaatgccatatggctctacggacctgcgaccaccggaaagaccaacatagccgaggctattgcccatgctgtacccttctatggctgtgttaactggactaatgagaacttcccatttaatgactgtgttgataaaatgcttatatggtgggaggagggaaaaatgaccaataaagtagtggaatccgcaaaagcgatactgggggggtctgctgtacgggttgatcaaaagtgtaaggggtctgtttgtattgaacctactcctgtaataattaccagtaatactgatatgtgcatgattgtggatggaaattctactacaatggaacacagaattcctttggaggaaagaatgttccagattgttctttcccataagctggaaggaaattttggaaaaatttcaaaaaaggaggtaaaagagtttttcaaatgggccaatgataatcttgttccagtagtttctgagtccaaagttcccacgaatgaacaaaccaaacctcctgagcccgttcctgaacgagcgaatgagccttccgagcctcctaagatatgggctccacctactagggaggagctagaggagatattaagagcgagccctgagctctttgcttcagttgctcctctgccttccagtccggagagatctcctaagagaaagaaaacccgtggggactatcaggtacgctgtgctatgcacagtttagataactctatgaatgtttttgaatgcctggagtgtgaaagagctaattttcctgaatttcagagtctgggtgaaaacttttgtaatcaacatgggtggtatgattgtgcattctgtaatgaactgaaagatgacatgaatgaaattgaacatgtttttgctattgatgatatggagaatgaacaataaaggtgattcaaaatagctatgtctacttttttagagaaatttgaagactggtatgagactgcagccgcatcttggcggcatttgaaagctggagcccccaagccaaaatcaaaccagcaatctcagtctgtgtctacagacagaaaaccccaacgaaaagacaataataggggctttgtacttcctggctataagtatcttgggcctggtaacgggcttgataaaggcccacctgtcaataaagcggacagcgtcgcgcttgagcacgataaagcgtacgaccagcagctcaaggcaggagacaacccctatatcaaatttaatcacgcagatcaagaatttatagataatctgcaaggtgatacctcctttggaggcaacctcggaaaagccgtattccaagctaaaaaaagaattctagagcctttaggcctagtagaagaacctgtaaacacggctcctgctaaaaagagtagtggaaaactaacagatcactaccctatagtaaagaagcctaaattatctgaagaaaactctccttcacctagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcattaccaagactacaagaacctgggtcctgtcaagctacaacaaccacatctacaaagccatcacaagcggaacaaacccagactcaaatacccaatatgctggatacagcaccccctgggggtactttgatttcaacagattccactgccatttctctccaagagactggcagagactcatcaacaaccattgggggattagaccgaaagcactcaaattcaagatattcaatgtacaagttaaagaagtcacgacgcaagaccagacaaagactattgctaacaaccttacctctacaatccagatattcacggataatgaacaccagctgccctatgttctgggctcggccacggaggggacgatgccaccgttcccctcagatgtgtatgccttgccccagtacggctactgcacaatgcacaccaaccagagtggagctagattcaatgacagaagtgccttctattgcttagagtacttccccagtcagatgctgagaacagggaataattttgaattcagttttgagtttgaagaagttcccttccatagcatgttcgctcattcacaggatttagacaggctaatgaatcctctcctagatcagtacctgtggaatttctctgaggttaatggtggcaggaatgcacagttcaagaaagctgtgaaaggagcatttggtgcaatggggagaaattggtttccaggacccaaacttctagaccaaagggtaagagcatacagtggaggaacagataactatgcgaactggtcaatctggagtaaaggaaacaaagtttttcttaaagacagagagtatctactgcaaccaggtccagtagctactacacatacagaagatcaggcttccagtataccggctcaaaacacaataggaattgcaaaagacccctacaggtcaggcagtagtctggcaggaatttcagacattatggtaacagaggagcaagaaatagcaccaactaatggtgtagggtggagaccttatggattgaccgtaaccaatgaacaaaacacaacaacagctcctacaaatgctgacctacaagtactgggagcgctacctggcatggtctggcagaacagagatatttacctgcagggtcctatatgggctaaaatacccaaaacagatgggaaatttcatccttctccaaacctgggaggttttggtctccataatccacctccccaggtctttataaaaaatactcctgttcctgcagatcctccagtagagtatgtaaatcaaaagtggaattcttacattacacagtattcaacagggcagtgtactgtagaaatggtctgggaactcagaaaagaaaactccaagagatggaaccctgagatccagtttaccagtaactttggaaatagaacaagtactatgtttgctccgaatgagactggaggctatgtagaagataggctgattggtaccaggtatttgactcagaatctgtaaatttctgtattcttttgatttttaaataaagcatttcctggcgcgcaaaaagtcctgctgtccttgagtctcattggagggttcgttcgttcgaaccagccaat

SEQ ID NO: 68 - DNA, 4234 bp, Muscovy duck parvovirus
tttccggttgcattcattcgttgctctgctctcacagagaacggacctcaggtcaggaaaatggcattttctaggcctcttcagatttcttctgacaaattctatgaagttatcatcaggctaccctcggatattgatcaagatgtgcctggtttgtctcttaactttgtagaatggctttctacgggggtctgggagcccaccggaatatggaatatggagcatgtgaatctccccatggttactctggcagacaaaatcaagaacattttcatccagagatggaaccaattcaatcaggacgaaacggatttcttctttcaattggaagaaggcagtgagtacatccatctgcattgctgtattgctcaggggaatgtccgatcttttgttctggggagatacatgtctcaaattaaagactcaattctgagagatgtgtatgaagggaaacaggtaaaaaacccggattggttttctataactaaaaccaaacggggagggcaaaataagaccgtgactgctgcttatattctgcattacctgattcctaaaaaacaaccggaattacaatgggcttttaccaatatgccccttttcactgctgctgctttatgcctccaaaagaggcaagagttactggatgcttttcaggaaagtgagatgaatgctgtagtgcaggaggatcaagcttcaactgtagctccccttatttccaacagagcagcaaagaactatagcaatctggttgattggctcattgagatgggtatcacctctgaaaaacagtggctaactgaaaataaagagagctaccggagctttcaggctacatcttcaaacaacagacaagtaaaagcagcacttgaaaatgcccgagcagaaatgctactaacgaaaactgccacagactatttgattggaaaagacccagttctggacattactaaaaatcggatctatcaaattctgaagttgaataactataaccctcaatatgtagggagcatcctatgcggatgggtgaaaagagaattcaacaaaagaaatgccatatggctctacggacctgcgaccaccggaaagaccaacatagccgaggctattgcccatgctgtacccttctatggctgtgttaactggactaatgagaacttcccatttaatgactgcgttgataaaatgcttatatggtgggaggaaggaaaaatgaccaataaagtagtggaatccgcaaaagcgatactgggggggtctgctgttcgagttgatcaaaagtgtaaggggtctgtttgtattgaacctactcctgtaataattaccagtaatactgatatgtgcatgattgtggatggaaattctactacaatggaacacagaattcctttggaggaaagaatgttccagattgttctttcccataagctggaaggaaattttggaaaaatttcaaaaaaggaggtaaaagagtttttcaaatgggccaatgataatcttgttccagtagtttctgagttcaaagtccctacgaatgaacaaaccaaacttactgagcccgttcctgaacgagcgaatgagccttccgagcctcctaagatatgggctccacctactagggaggagctagaggagatattaagagcgagccctgagctctttgcttcagttgctcctctgccttccagtccggagagatctcctgagagaaagaaaacccgtggggactatcaggtacgctgtgctatgcacagtttagataactctatgaatgtttttgaatgcctggagtgtgaaagagctaattttcctgaatttcagagtctgggtgaaaacttttgtaatcaacatgggtggtatgattgtgcattctgtaatgaacagaaagatgacatgaatgaaattgaacatgtttttgctattgatgatatggagaatgaacaataaaggtgattcaaaatagctatgtctacttttttagagaaatttgaagactggtatgagactgcagccgcatcttggcggcatttgaaagctggagcccccaagccaaaatcaaaccagcaatctcagtctgtgtctacagacagaaaaccccaacgaaaagacaataataggggctttgtacttcctggctataagtatcttgggcctggtaacggccttgatataggcccacctgtcaataaagcggacagcatcgcgcttgagcacgataaagcgtacgaccagcagctcaaggcaggagacaacccctatatcaaatttaatcacgcagatcaagaatttatagataatctgcaaggtgatacctcctttggaggcaacctcggaaaagccgtattccaagctaaaaaaagaattctagagcctttaggcctagtagaagaacctgtaaacacggctcctgctaaaaagagtagtggaaagctaacagatcactaccctatagtaaaaaagcctaaattatctgaagaaaactctccttcacccagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcattaccaagactacaagaacctgggtcctgccaagctacaacaaccacatctacaaagccatcacaagcggaacaaacccagactcaaatacccaatatgctggatacagcaccccctgggggtactttgatttcaacagattccactgccatttctctccaagagactggcagagactcatcaacaaccattgggggattagaccgaaagcactcaaattcaagatattcaatatgcaagttaaagaagtcacgacgcaagaccagacaaaaactattgctaacaaccttacctctacaatccagatattcacggataatgaacaccagctgccctatgttctgggctcggccacggaggggacgatgccaccgttcccctcagatgtgtatgccttgccccagtacggctactgcacaatgcacaccaaccagagtggagctggattcaatgacagaagtgccttctattgcttagagtacttccccagtcagatgctgagaacagggaataattttgaattcagttttgagtttgaagaagttcccttccatagcatgttcgctcattcacaggatttagacaggctaatgaatcctctcctagatcagtacctgtggaatttctctgaggttaatggtggcaggaatgcacagttcaaaaaagctgtgaaaggagcatttggtgcaatggggagaaataggcttccaggacccaaacttctagaccaaagggtaagagcataccgtggaggaacagataactatgcgaactggtcaatctggagtaaaggaaacaaagtttttcttaaagacagagagtatctactgcaaccaggtccagtagctactacacatacagaagatcaggattccagtataccggctcaaaacacaataggaattgcaaaagacccctacaggtcaggcagtagtctggcaggaatttcagacattatggtaccagatgagcaagaaatagcaccaactaatggtgtagggtggagaccttatggattgaccgtaaccaatgaacaaaacacaacaacagctcctacaaatgctgacctacaagtactgggagcgctacctggcatggtctggcagaacagagatatttacctgcagggtcctatatgggctaaaatacccaaaacagatgggaaatttcatccttctccaaacctgggaggttttggtctccataatccacctccccaggtctttataaaaaatactcctgttcctgcagatcctccagtagagtatgtaaatcagaagtggaattcttacattacacagtattcaacagggcagtgtactgtagaaatggtctgggaactcagaaaagaaaactccaagagatggaaccctgagatccagtttaccagtaactttggaaatagaacaagtactatgtttgctccgaatgagactggaggctatgtagaagataggctgattggtaccaggtatttgactcagaatctgtaaatttctgtattcttttgattttaaataaagcatttcctggcgcgcaaaaagtcctgctgtccttgagtctcat

SEQ ID NO: 69 - DNA, 5061 bp, Muscovy duck parvovirus
ctcattggagggttcgttcattcgaaccggccaatcaggggaggggggaagtgacgtaagttccggtcacgtgcttccggtcacgtgcttccggtcatgtgacttccggtcacgtgtttcctgtcacgtgacttccggtgacgcacttcctttgatgacgtatttccggttgtcaaggctgatcgggcgcatgcgcgtggtcaacctaacagccggaaatacgtcatcaaaggaagtgcgtcaccggaagtcacgtgacaggaaacacgtgaccggaagtcacatgaccggaagcacgtgaccggaagcacgtgaccggaacttacgtcacttcccccctcccctgattggccggttcgaacgaacgaaccctccaatgagactcaaggacagcaggactttttgcgcgccaggaaatgacgttaggggctgccctatataagccagtaagcttccggtttggttcattcgttactctgctctcacagagaacggacctcaggtcggagacatggcactttctaggcctctgcagatttcttctgataaattctatgaagttattattagattaccctcggatattgatcaggatgttcccggtctgtctcttaactttgtagaatggctttctacgggggtctgggagcccaccggaatatggaatatggagcatgtgaatctccccatggttactctggcagacaaaatcaagaacattttcatccagagatggaaccaattcaatcaggacgaaacggatttcttctttcaattggaagaaggcagtgagtacatccatctgcattgctgcattgcccaggggaatgtccgatcttttgttctggggagatacatgtctcaaattaaagactcaattctgagagatgtgtatgaagggaaacaggtaaaaatcccggattggttttctataactaaaaccaaacggggagggcaaaataagaccgtgactgctgcttatattctgcattacctgattcctaaaaaacaaccggaattacaatgggcttttaccaatatgccccttttcactgctgctgctttatgcctccaaaagaggcaagagttactggatgcttttcaggaaagtgagatgaatgctgtagtgcaggaggatcaagcttcaactgtagctccccttatttccaacagagcagcaaagaactatagcaatctggttgattggctcattgagatgggtatcacctctgaaaaacagtggctaactgaaaataaagagagctaccggagctttcaggctacatcttcaaacaacagacaagtaaaagcagcacttgaaaatgcccgagcagaaatgctactaacaaaaactgccacagactatttgattggaaaagacccagttctggacattactaaaaatcggatctatcaaattctgaagttgaataactataaccctcaatatgtaggaagcatcctatgcggatgggtgaaaagagaattcaacaaaagaaatgccatatggctctacggacctgcgaccaccggaaagaccaacatagccgaggctattgcccatgctgtacccttctatggctgtgttaactggactaatgagaacttcccatttaatgactgcgttgataaaatgcttatatggtgggaggagggaaaaatgaccaataaagtagtggaatccgcaaaagcgatactgggggggtctgctgtacgagttgatcaaaagtgtaaggggtctgtttgtattgaacctactcctgtaataattaccagtaatactgatatgtgcatgattgtggatggaaattctactacaatggaacacagaattcctttggaggaaagaatgttccagattgttctttcccataagctggaaggaaattttggaaaaatttcaaaaaaggaggtaaaagagtttttcaaatgggccaatgataatcttgttccagtagtttctgagttcaaagtccctacgaatgaacgaaccaaacttactgagcccgttcctgaacgagcgaatgagccttccgagcctcctaagatttgggctccacctactagggaggagctagaggagatattaagagcgagccccgagctctttgcttcagttgctcctctgccttccagtccggagagatctcctgagagaaagaaaacccgtggggactatcaggtacgctgtgctatgcacagtttagataactctatgaatgtttttgaatgcctggagtgtgaaagagctaattttcctgaatttcagagtctgggtgaaaacttttgtaatcaacatgggtggtatgattgtgcattctgtaatgaactgagagatgacatgaatgaaattgaacatgtttttgctattgatgatatggagaatgaacaataaagatgattcaaaatagctatgtctacttttttagagaaatttgaagactggtatgagactgcagccgcatcttggcggcatttgaaagctggagcccccaagccaaaatcaaaccaacaatctcagtctgtgtctacagacagaaaaccccaacgaaaagacaataataggggctttgtacttcctggctataagtatcttgggcctggtaacggccttgataaagggccacctgtcaataaagcggacagcgtcgcgcttgagcacgataaagcgtacgaccagcagctcaaggcaggagacaacccctatataaaatttaatcacgcagatcaagaatttatagataatctgcaaggtgatacctcctttggaggcaacctcggaaaagccgtattccaagctaaaaaaagaattctagagcctttaggcctagtagaagaacctgtaaacacggctcctgctaaaaagagtagtggaaaactaacagatcactaccctatagtaaagaagcctaaattatctgaagaaaactctccttcacctagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaacagattccactgccacttctctccaagagactggcagagacttatcaacaaccattggggaatcagacccaagtctcttaaattcaagatcttcaatgtccaggtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtactgcaccatgcacaccaaccagaatggagcacggttcaatgaccgtagtgcattctactgcttagagtacttccctagtcagatgctaagaacaggcaacaactttgagttcacatttgactttgaagaagttcctttccatagcatgttcgctcattcacaggacttagacaggctgatgaaccccctagtggatcaatacctctggaatttcaatgaggtagacagcaacagaaatgctcaatttaaaaaggctgtgaaaggcgcttatggcaccatgggccgcaattggctgccaggacctaaattcctggaccagagagttagggcctatccaggcggaacagataattatgcaggctggaacatctggaataatggaaacaaggttaatttgaaggacaggcagtacctcctgcaacctggacctgtatcagctactcacacagaagcagaggcttccagcatcccagcccaaaatattttaggtttagctaaagatccatacagatctggcagcactgcagcaggaataaatgatattatggtaacggacgagcaggaagtagcacctacaaacggtgtagggtggaaaccatatggcaagactgtaacgaatgaacaaaacactactagagctcctacgagttcagatcttgatgttcttggagctttaccaggaatggtttggcagaacagagatatatatctacagggtcctatatgggctaaaatacccaaaacagatgggaaatttcatccttctccaaacctgggaggttttggtctccataatccacctccccaggtctttattaaaaatacccctgttcctgcagatcctccactagagtatgtaaatcagaagtggaattcttacattacacagtattcaacagggcagtgtactgtagaaatggtctgggaactcagaaaagaaaactccaagagatggaaccctgagatccaatttaccagtaactttggaaatagaacaagtactatgtttgctccaagtgagactggaggctatgtagaagataggctgattggtaccagatatttgactcagaatctgtaaatttctgtattcttttgaatttaaataaaccatttcctggcgcgcaaaaagtcctgctgtccttgagtctcattggagggttcgttcattcgaaccggccaatcaggggaggggggaagtgacgtaagttccggtcacgtgcttccggtcacgtgcttccggtcatgtgacttccggtcacgtgtttcctgtcacgtgacttccggtgacgcacttcctttgatgacgtatttccggttgtcaaggctgatcgggcgcatgcgcgtggtcaacctaacagccggaaatacgtcatcaaaggaagtgcgtcaccggaagtcacgtgacaggaaacacgtgaccggaagtcacatgaccggaagcacgtgaccggaagcacgtgaccggaacttacgtcacttcccccctcccctgattggccggttcgaacgaacgaaccctccaatgag

SEQ ID NO: 70 - DNA, 1297 bp, Serpentine adeno-associated virus
ccattctgtaactgtccgggaaaaatgttaatttggtgggaggagggtaaaatgactcaaaaaattgtggaaaccgctaaatgtatattaggtggaactagagtacccgtagatgttaaatgtaaaatggccgaaatatgtgaaggcactcctgtaattattaccagtaataccaacatgtgtcaagtatttgatgggaatagttctagttttgaacacaccgagccgttacaggaacgcatgtttaaaattagattaaatattaaactgccttcagactttggccgagtaactaaacaggaagtacaagattttataaggtggggctctgatcatccaatggaaattagccacgtatttgaaacaccaaaagaggccccgccccttattcaaacgcctataaaaaaccgagagaaagaggcggaaacttcatttgaagagcaaccgccgagtaagagggtgtgtcttgatagcgagaagcaggtaagacatactacggaaatttgtaacaatattgtacctagagctaacttgttagaacttgctaatactactcaatgcatgttacacggtacatttacttgtatggaatgttatcctgaattgactgaatgtgttgatgatgttgatgtcgaacaataaagcttactgataatagacatggattttgtcgataattttttcacagacaaatataaagagacttacaaagaactctctaaacctgttaatcctcccccggtacagcatattagcgaaaagcattccgaacctggatcgaggggtcttgtggtgcctggttataagtatcttgggcctggcaatagcttggaccgtggagaacccgttaaccaagcagacgctgctgccaaagaacacgacatctcgtacgacaaacaactcaaagtcggagataatccgtacgtaaagtacaatcacgccgacgaacagtttcaacagaaactagaaggcgacaccagtttagccggaaacgccgctaacgccgtcttccaagccaagaagcgcctactagaaccgtttggtctagtagaagcgcccctaccggccaaaacggatagcaagaaagtagacgactactttccgaaagcaaagaaagcaaaacagagctttcaaatcccggcaccctctaaaagcgatccgggagaaggtacttctgcccagtctggaggtagcccagcaggttccgatactagcggctcatctatcatggctgaaggaggaggcggaccaatggcaagcgatcaacaaggtgccgagggagtgggtaattcctcag

SEQ ID NO: 71 - DNA, 4432 bp, Snake parvovirus
cgccccacccctagtgatcgcgcgcgctctctcttggggcctgacggccgaaggccgtcagctgccgagcttcgctcggcaggccccaagagagagcgcgcgcgatcactaggggtggggcgagtgccctgctcaacgggttttttggtgggcggagcaatgacgtcagcggacatgtctggacatgtctttgagcaagtccatataaggagttccgccggatatgcaaatgagcaatcgcgcaaagcattttgggtagtcaccatgaataaaaaggacagcaagaaagatgacgccccataattttaataggaattttaaccatggcgttttacgaggttgtgtttcgtttgccaagagacaataacaacttgttggatgaagatagatatcagccagagttgaaagaagaagatgactggcctgaggaatatttaaccagtgaagatgccagctttatcggactagcgtatgctgtgctaagtgaaattcggagattctttggaaaggaactacaatggtttgcccaggttgaatggtgtcctactgctggttaccacatgcatgttttgttgaaccatcctaagctgagtaaccagacttatggaagaaaggtcaatgaactggcttgccgtatagtcgatacctttggcctaattaatccagaagaagtcatcagtacccattatgttaaaagcaactatggacataaaaaggtgagagtcattcacctagagtcttatttgaagaactactttttcagaaagactttagctcctcccaattataccgaggaaggagactataaaagagaggaagaagtcgtgctgtgggcatttacgaatatcgtcgcttggaagccattcgtgcggaatctcatcaagagatcggagctagcgactgttcctaagcaaccagagaatccggcgggagacggaccggcacctcgagtgactgcaggaacccgccattttatggaaaccatcgactggttggtgaaacatggaattactacagaacgagaattctgccacgccaaccgccctttgtacctgtctatgctggcttctacttcgggtgctgggcagattaaaagagcgctggaccaggcgaaacacatgatgaccagcaccatgtcagcagaggattacctgacaacagaagaggatgtgatcgaaccacctactgaaaatagaatctacaagattatgaaactgaatcgctatgatccagaactagcagctgctctcttctacggctggacctgcaagaactttggcaagagaaacaccatctggctgtatggtccagctactaccggcaaaaccatcatcgctcaagctattgcacatgctgttaaactgtttgctggtgttaattggactaatgaaaactttcccttctgtaactgtccagggaaactgcttatctggtgggaggagggcaagatgacaaacaaaatggtggagacggctaaatgtatactggggggatctgctgtacctgtagacatcaaaggcaaacccgctgaaatgtgtcctcaaacaccctgtattattactagcaatactaacatgtgtcaagtatatgatggtaatagttctagctttgagcaccaagaacccctagaggaacgcatgtttatgttcagacttaatactaaactgccatcgacctttggcaagatcacagaagaggaagtcaaacagtttattacctgggggaggagcttaaaggttcaagttccacatcagttcagagtgcctaccacaggagagtataaaaggccagcccccgaggcgaaagctcattcttcggatgagccgccaaaagagaaggtcgcgcgtattgatgactctctaaccaggtatgttaacaatattgatgagtcagctaccagtagagaaatgtttctagagattgctaatactaatcaatgtatgttgcatcattgcttttcttgtaccgaatgttatcctgaattgcttgatgacatggacaaggaacaataaacttactgataacagatatggattttctcgatgatttctttgcagataaatataaagagactgttaacgaactcggtaaaccggtcaatcctaaacctgtaaaacacattagcgaagctcactcgcaacctggcagcaggaggggctttgtggtgcctgggtatcggtatcttgggcctggtaatagcttggaccgtggaaagcccgttaacaaagcagacgaggctgctaaaaagcacgatcaagaatacgatcaacagcttaaagcgggagacaatccctacataaaatataatcacgcggacgaacagttccagaaagacctacaaggtgataccagtctagccggcaacgcggctaacgctctatttcaaggcaaaaagactctactagcgccccttggcctagtagagacccctgtcggcaaaacgtctgaaaagcacaaattagacgaatactatcctaaagctaaaaaggccaaacaaggcttgcagataccagctccacctaaaggcggagaagaagaagctacatcgtcacaatctggagggagcccagcaggttccgatactagcggcacatctgtcatggctacaggaggaggcggtccgatggcagacgataaccagggcgccgagggagtgggtaattcctcaggtgattggcattgcgataccaagtggatgggagaccacgtcattacaaagtcaaccagaacttgggtgctccccacttacgggaatcatctctacgggcctatcaactttgacggcaccacaggttcgggtgctaatgcagcctatgcaggatacaagactccctgggggtactttgacttcaatcgattccattgccacttctccccccgagactggcaaagactcatcaacaaccacacaggcatcaggccgaaaggactcaaaatcaaagtctttaacgtccaagtcaaagaagttacaacacaagattcaacgaaaacaattgccaacaatctcaccagcaccgtacagatctttgcggacgagaactacgacttaccatatgtattaggcagtgctacacaaggcacatttcctccatttcccaatgatgtatttatgttaccacaatatgcttattgtacacttcaaggaaattcggggaaatttgtagatagaagtgccttttattgtttagaatattttccttcacaaatgctgagaacaggaaacaattttgagttccagtttaaatttgaagaagttccctttcattctggatgggcacagagtcaaagcctagacagattgatgaatccgttgcttgatcaatatctgataggagactatggaacagatgcatcaggaaaccttatttatcacagagctggtccaaatgatttgaatgaattctacaagaattgggcacctgcaccctatgaatgtatccagaatattaacagcagtgataataccaagaatgctaattctataaatggttcaaattctaccaacaaatggggactacaaggaagacaagcatgggatgctccaggatttgttcaagctagtacctatgaaggtgcagcagcaggacaatctcttcttaatggcgtacttactttcgataaaagttcagctactacttcatctccagctgctactgcagtaaacagaacaattgaagacgaaatacagggtaccaataattttggtaatgctagaaataacattgttgctatcaatcaacaaacgaaaggaacaaatccaacaacaggtagtacatctcaatttgagacaatgccaggtatggtgtggtctaatagagacatttacttacaggggcctatttgggctaaaattccaaatacagatggacattttcatccttctcccagaatgggtggttttggattaaaacatcctccgcctatgattctgatcaaaaatacaccagttcctgctgatcctccaactaccttcaatccaatgccacagactagtttcattactgaatacagtacaggacaagtaactgttgaaatgttgtgggaggtacagaaagaatcctccaaaagatggaatccagaagtacagtttacttccaattttggaacttcagatccagctgttgatggaataccgtttggaattaataatttgggtacttatgttgaatctagacctattggaactcgttatatttctaaacacttgtaaataataaaaattgtcaaatttgcactaagaattgttgtcacgtggttgtttacatgcttgctaaaacacgcccaccaaaaaacccgttgagcagggcactcgccccacccctagtgatcgcgcgcgctctctcttggggcctgccgagcgaagctcggcagctgacggccttcggccgtcaggccccaagagagagcgcgcgcgatcactaggggtggggcg

SEQ ID NO: 72 - DNA, 1884 bp, Duck parvovirus
atggcattttctaggcctcttcagatttcttctgacaaattctatgaagttatcatcaggctaccctcggatattgatcaagatgtgcctggtttgtctcttaactttgtagaatggctttctacgggggtctgggagcccaccggaatatggaatatggagcatgtgaatctccccatggttactctggcagacaaaatcaagaacattttcatccagagatggaaccaattcaatcaggacgaaacggatttcttctttcaattggaagaaggcagtgagtacatccatctgcattgctgcattgcccaggggaatgtccgatcttttgttctggggagatacatgtctcaaattaaagactcaattctgagagatgtgtatggagggaaacaggtaaaaatcccggattggttttctataactaaaaccaaacggggagggcaaaataagaccgtgactgctgcttatattctgcattacctgattcttaaaaaccaccgggaattacaatgggcttttaccaatatgccctttttcactgctgctgctttatgcttccaaaagaggcaagagttactggatgcttttcaggaaagtgagatgaatgctgtagtgcaggaggatcaagcttcaactgtagctccccttatttccaacagagcagcaaagaactatagcaatctggttgattggctcattgagatgggtatcacctctgaaaaacagtggctaactgaaaataaagagagctaccggagctttcaggctacatcttcaaacaacagacaagtaaaagcagcacttgaaaatgcccgagcagaaatgctactaacaaaaactgccacagactatttgattggaaaagacccagttctggacattactaaaaatcggatctatcaaattctgaagttgaataactataaccctcaatatgtagggagcatcctatgcggatgggtgaaaagagaattcaacaaaagaaacgccatatggctctacggacctgcgaccaccggaaagaccaacatagccgaggctattgcccatgctgtacccttctatggctgtgttaactggactaatgagaacttcccattcaatgactgcgttgataaaatgcttatatggtgggaggagggaaaaatgaccaataaagtagtggaatccgcaaaagcgatactgggggggtctgctgtacgagttgatcaaaagtgtaaggggtctgtttgtattgaacctactcctgtaataattaccagtaatactgatatgtgcatgattgtggatggaaattctactacaatggaacacagaattcctttggaggaaagaatgttccagattgttctttcccataagctggaaggaaattttggaaaaatttccaaaaaggaggtaaaagagtttttcaaatgggccaatgataatcttgttccagtagtttctgagttcaaagtccctacgaatgaacaaaccaaacttactgagcccgttcctgaacgagcgaatgggccttccgagcctcctaagatatgggctccacctactagggaggagctagaggagaccctaagaacgagccctgagctctttgcttcagttgctcctctgccttccagtccggagagatctcctaagagaaagaaaacccgtggggactatcaggtacgctgtgctatgcacagtttagataactctatgaatgtttttgaatgcctggagtgtgaaagagctaattttcctgaatttcagagtctgggtgaaaacttttgtaatcaacatgggtggtatgattgtgcactctgtaatgaactgagagatgacatgaatgaaattgaacatgtttttgctattgatgatatggagaatgaacaataa

SEQ ID NO: 73 - DNA, 1884 bp, Goose parvovirus
atggcactttctaggcctctgcagatttcttctgataaattctatgaagttattattagattaccatcggatattgatcaggatgttcccggtctgtctcttacctttgtagaatggctttctaccggagtttgggagcccacgggcatctggaacatggagcgtgtgaatctaccgatggtgactttggcagagaaaatcaagaatatcttcatacaaaggtggaatcagttcaatcaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaaggaaaacaaatcaagatccccgattggtttgctatcactaaaaccaagcggggaggacaaaataagaccgtgactgcagcatacatattgcactacctgatacctaaaaaacaacctgagctgcaatgggcctttaccaatatgccattatttagtccggctgctctttgtctgcaaaagcggcaagaattgctggatgcatttcaagaaagcgatttggccgcccctttacctgatcctcaggcatcaactgtggcaccacttatttccaacagagcggcaaagaactatagcaaccttgttgattggctcattgaaatgggcataacatccgagaagcagtggctcactgagaaccgagagagctacagaagttttcaagcaacttcttcaaataatagacaagtgaaagctgcattggaaaatgcccgtgccgaaatgctattaacaaagactacaaccgattacctgataggaaaagatcctgtcctggacataactaagaacagggtctatcaaattctgaaaatgaataattacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgcgttaactggactaacgagaactttccttttaatgattgtgtcgataagatgttgatttggtgggaggagggaaagatgactaacaaggttgtagagtctgcgaaagcaattttggggggctctgctgtccgggtagaccagaaatgtaaagggtctgtttgtattgaacctactcctgtaattattaccagtaacactgacatgtgtatgattgttgatggtaactccactacgatggagcatagaataccactagaggagcgtatgtttcaaatcgtactatcacataaattagagccttctttcggaaaaatctcgaaaaaagaagttagagaattctttaaatgggccaatgataacttagttcctgttgtatctgagttcaaagtccgaacgaatgaacaaaccaacttgccagagcccgttcctgaacgagcgaacgagccggaggagcctcctaagatctgggcccctcctactagggaggagttagaagagcttttaagagccagcccggaactgttctcagcagttgctccgattcctgtgactcctgagaactctcccgagcctaagagaagcaggaacaattaccaggtacgatgtgctttgcatacttatgacaattctatggatgtctttgaatgtatggactgcgagacggccaattttccggaatttcaacctctgggggaaaactgttgtgatgaacatgggtggtatgactgtactatctgtaaagaattgaaagatgaacttgcagaaattgagcatgtgtttgagcttgatgatgctgaaaatgaacaataa

SEQ ID NO: 74 - DNA, 1884 bp, Goose parvovirus
atggcactttctaggcctcttcagatttcttctgataaattctatgaagttatcattagattaccatcggatattgatcaagatgtccccggtctgtctcttaactttgtagaatggctttctaccggagtttgggagcccacgggcatctggaacatggagcatgtgaatctaccgatggtgaccttggcagagaagatcaagaacattttcatacaaagatggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaagggaaacaaatcaagatccccgattggtttgctattactaaaaccaagaggggaggacagaataagaccgtgactgcagcatacatactgcattaccttattcctaaaaagcaacctgaactgcaatgggcctttaccaatatgcctttattcactgctgctgctctttgtctgcaaaagcggcaagaattgctggatgcatttcaagaaagtgatttggctgcccctttacctgatcctcaagcatcaactgtggcaccgcttatttccaacagagcggcaaagaactatagcaaccttgttgattggctcattgaaatggggataacatctgagaagcaatggctcactgagaaccgagagagctacagaagctttcaagcaacttcttcaaataatagacaagtgaaagctgcactggaaaatgcccgtgctgaaatgttattgacaaagactgcaaccgattacctgataggaaaagaccctgtcctggacataactaagaatagggtctatcagattctgaaaatgaataactacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgtgttaactggactaatgagaactttccttttaatgattgtgttgataaaatgctgatttggtgggaggagggaaaaatgactaataaggttgttgaatctgcaaaagcaattttaggagggtctgctgtccgggtagaccagaaatgtaaaggatctgtttgtattgaacctactcctgtaattattactagtaatactgatatgtgtatgattgttgatggcaactctactacaatggaacatagaataccgttagaggagcgtatgtttcaaatcgtcctatcacataaattggagccttcttttggaaaaatttctaaaaaagaagtcagagaatttttcaaatgggccaatgataatctagttcctgttgtgtctgagttcaaagtccgaacgaatgaacaaactaacttgccagagcccgttcctgaacgagcgaacgagccggaggagcctcctaagatctgggctcctcctactagggaggagttagaagagcttttaagagccagcccagaattgttctcatcagtcgctccaattcctgtgactcctcagaactcccctgagcctaagagaagcaggaacaattaccaggtacgctgcgctttgcatacttatgacaattctatggatgtatttgaatgtatggaatgtgagaaagcaaactttcctgaatttcaacctctgggagaaaattattgtgatgaacatgggtggtatgattgtgctatatgtaaagagttgaaaaatgaacttgcagaaattgagcatgtgtttgaacttgatgatgctgaaaatgaacaataa

SEQ ID NO: 75 - DNA, 1884 bp, Goose parvovirus
atggcactttctaggcctctgcagatttcttctgataaattctatgaagttattattagattaccatcggatattgatcaggatgttcccggtctgtctcttacctttgtagaatggctttctaccggagtttgggagcccacgggcatctggaacatggagcgtgtgaatctaccgatggtgactttggcagagaaaatcaagaatatcttcatacaaaggtggaatcagttcaatcaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaaggaaaacaaatcaagatccccgattggtttgctatcactaaaaccaagcggggaggacaaaataagaccgtgactgcagcatacatattgcactacctgatacctaaaaaacaacctgagctgcaatgggcctttaccaatatgccattatttagtccggctgctctttgtctgcaaaagcggcaagaattgctggatgcatttcaagaaagcgatttggccgcccctttacctgatcctcaggcatcaactgtggcaccacttatttccaacagagcggcaaagaactatagcaaccttgttgattggctcattgaaatgggcataacatccgagaagcagtggctcactgagaaccgagagagctacagaagttttcaagcaacttcttcaaataatagacaagtgaaagctgcattggaaaatgcccgtgccgaaatgctattaacaaagactgcaaccgattacctgataggaaaagatcctgtcctggacataactaagaacagggtctatcaaattctgaaaatgaataattacaaccctcaatacataggaagtatcctgtgcggctgggtgaagagagagttcaacaaaagaaacgccatatggctctacggacctgccaccaccgggaagaccaacattgcagaagctattgcccatgctgtacccttctatggctgcgttaactggactaacgagaactttccttttaatgattgtgtcgataagatgttgatttggtgggaggagggaaagatgactaacaaggttgtagagtctgcgaaagcaattttggggggctctgctgtccgggtagaccagaaatgtaaagggtctgtttgtattgaacctactcctgtaattattaccagtaacactgacatgtgtatgattgttgatggtaactccactacgatggagcatagaataccactagaggagcgtatgtttcaaatcgtactatcacataaattagagccttctttcggaaaaatctcgaaaaaagaagttagagaattctttaaatgggccaatgataacttagttcctgttgtatctgagttcaaagtccgaacgaatgaacaaaccaacttgccagagcccgttcctgaacgagcgaacgagccggaggagcctcctaagatctgggcccctcctactagggaggagttagaagagcttttaagagccagcccggaactgttctcagcagttgctccgattcctgtgactcctgagaactctcccgagcctaagagaagcaggaacaattaccaggtacgatgtgctttgcatacttatgacaattctatggatgtctttgaatgtatggactgcgagacggccaattttccggaatttcaacctctgggggaaaactgttgtgatgaacatgggtggtatgactgtactatctgtaaagaattgaaagatgaacttgcagaaattgagcatgtgtttgagcttgatgatgctgaaaatgaacaataa

SEQ ID NO: 76 - DNA, 220 bp, Peromyscus adeno-associated virus
ttcaagtctttacggatgacgactaccagttgccctacgtcctcggcaacgcgactgaaggctgcctgccggcgttcccgccggaggtattcaccctaccccagtacggctacgcgacgctaaacactccaacgagcggacaacctgtggagcggagtgccttcttctgcctggagtactttccctccaaaatgctgagaaccggcaacaactttgaatt

SEQ ID NO: 77 - DNA, 422 bp, Peromyscus adeno-associated virus
acccagttctggaacactgtgactaatgctaacaaccaggcgggagttactgctagttctactagcaacacagtacagatccagggtcaaggcttcatgagccgcccagagccggctggcatgaccaacaacacagacaacagcaactgggttggcttggacaattccatgatcttcaacaatcagactgctgcccctggcgaaggttctcttctccaagtgaacaatatgcttatcaccaaagagaacgagactgatccagtgaatcctcaggccgacaaggtcgctggcaaggtcgcaagtaacaaccaagcaaacaccgtggctcctactgcgaccaccgtcgaccaccagggcgtactgcctggagctgtgtggatggacaaggacgtgtacttacacggacctatttgggccaagtt

SEQ ID NO: 78 - DNA, 280 bp, Peromyscus adeno-associated virus
ggattcccaacaccggagcccacttcccatccttctccgatgatgggaggtttcgggctgaagcatcctcctcctatgatgctgataaaaatactccggtgcctggcaacgtcaccaccttcagcgaccaaaaggttaatcaattcattaatcaatattcgaccggacaagtcaccgtatcgattacctgggagctgatgaaggaaaacagcaagcgatggaaccccgaactgcagtacaccaacaactaccccggttccctctttgtagactttgctcc

SEQ ID NO: 79 - DNA, 1884 bp, Goose parvovirus
atggcactttctaggcctcttcagatttcttctgataaattctatgaagttattattagattaccatcggatattgatcaagatgtccccggtctgtctcttaactttgtagaatggctttctaccggagtttgggagcccacgggcatctggaacatggagcatgtgaatctaccgatggtgaccttggcagagaagatcaagaacattttcatacaaagatggaatcagttcaaccaggacgaaacggacttcttctttcaactggaagaaggcagtgagtacattcatcttcattgctgtattgcccagggcaatgtacggtcttttgttctcgggagatatatgtctcagataaaagactctatcataagagatgtatatgaagggaagcaaattaagatccccgattggtttgctattactaaaaccaagagcggaggacagaataagaccgtgactgcaacatacatactgcattaccttattcctaaaaagcaacctgaactgcaatgggcctttaccaatatgcctttatttactgctgctgctctttgtctgcaaaagcggcaagaattgctggatgcatttcaagagagtgatttggctgcccctttacctgatcctcaagcatcaactgtggcaccgcttatttccaacagagcggcaaagaactatagcaaccttgttgattggctcattgaaatgggcataacatctgagaagcaatggctcactgagaaccgagagagctacagaagctttcaagcaacttcttcaaataatagacaagtgaaagctgcactggaaaatgcccgtgctgaaatgttattaacaaagactgcaactgattacctgataggaaaagaccctgtcctggacataattaagaatagggtctatcaaattctgaaaatgaataactacaaccctcaatacgtaggaagtatcctgtgcggctgggtgaagagagagttcaacaaaagaaacgccatatggctctacggacctgccaccaccgggaagaccaacattgcagaagctattgcccatgctatacccttctatggctgtgttaactggactaatgagaactttccttttaatgattgtgttgataagatgttgatttggtgggaggagggaaaaatgactaataaggttgttgaatctgcaaaagcaattttgggagggtctgctgtccgggtagaccagaaatgtaaaggatctgtttgtattgaacctactcctgtaattattactagtaatactgacatgtgtatgattgttgatggcaactctactacaatggaacatagaataccattagaggagcgtatgtttcaaattgtcctatcacataaattggaaccttcttttggaaaaatttctaaaaaagaagtcagagaatttttcaaatgggccaatgacaatctagttcctgttgtgtctgagttcaaagtccgaacgaatgaacaaaccaacttgccagagcccgttcctgaacgagcgaacgagccgaaggagcctcctaagatctgggctcctcctactagggaggagttagaagagcttttaagagccagcccagaattgttctcatcagtcgctccaattcctgtgactcctcagaactcccctgagcctaagagaagcaggaacaattaccaggtacgctgcgctttgcatacttatgacaattctatggatgtatttgaatgtatagaatgtgagaaagcaaactttcctgaatttcaacctctgggagaaaattattgtgatgaacatgggtggtatgattgtgctatatgtaaagagttgaaaaatgaacttgcagaaattgagcatgtgtttgagcttgatgatgctgaaaatgaacaataa

SEQ ID NO: 80 - DNA, 2211 bp, Adeno-associated virus
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 81 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggcagactggcgactcagagtcagtgcctgacccccaacctctctcagaaccacccgcaggtccctctggtctgggatctggtacaatggctgctggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactgggggttccggcccaagaagctcaacttcaagctcttcaacatccaggtcaaggaggtcacccagaatgaaggcaccaagaccatcgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgagccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggcgtggtggctgacaatctgcagcagaccaactcagctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 82 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccggcagcccgcgaaaaagagactgaattttgggcagactggcgactcagagtcagtgcctgacccccaacctctctcagaaccacccgcaggtccctctggtctgggatctggtacaatggctgcaggcggtggcgctccaatggcagacaataacgaaggcgccgacggagtgggtaatgcctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactggggattccggcccaagaggctcaacttcaagctcttcaacatccaggtcaaggaggtcacccagaatgaaggcaccaagaccatcgccaataacctcaccagcacggtgcaggtctttacggactcgaagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 83 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggccgactggcgactcagagtcagtgcctgacccccaacctctctcagaaccacctgcaggtccctctggtctgggatctggtacaatggctgcaggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgcgactggcagcgactcatcaacaacaactggggattccggcccaagaagctcaacttcaagctcttcaacatccaggtcaaggaggtcacccagaatgaaggcaccaagaccaccgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacggcagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagcgaaccccgccccattggcactcgttacctcacccgtaatctgtaa

SEQ ID NO: 84 - DNA, 2214 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacggcaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccgaaggtgtttactctgagcctcgccccattggtactcgttacctcacccgtaatttgtaa

SEQ ID NO: 85 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 86 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcggcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagcccttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgcactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgctacctcacccgtaatctgtaa

SEQ ID NO: 87 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcaggatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcgggctaagaactggctacctggaccttgctaccggcagcagcgagtctctacgacactgtcgcaaaacaacaacagcaactttgcttggactggtgccaccaaatatcacctgaacggaagagactctttggtaaatcccggtgttgctatggcaacgcataaggacgacgaggaacgtttctttccatcgagcggagtcctgatgtttggaaaacagggtgctggaagagacaatgtggactatagcagcgttatgctaaccagcgaggaagaaattaaaaccactaaccctgtagccacagaacaatacggtgtggtggctgacaacttgcagcaagccaatacagggcctattgtgggaaatgtcaacagccaaggagccttacctggcatggtctggcagaaccgagacgtgtacctgcagggtcccatctgggccaaaattcctcacacggacggcaattttcacccgtctcctctgatgggcggctttggactgaagcacccacctccccagatcctgatcaagaatacgccggtacctgcggatcctccaacgacgttcagccaggcaaaattggcttccttcatcacgcagtacagcaccggccaggtcagcgtggagatcgagtgggagctgcagaaggagaacagcaagcgatggaacccagaaattcagtacacttccaactactacaaatctacaaatgtggactttgctgtcaattctgagggtacatattcagagcctcgccccattggtactcgttatctgacacgtaatctgtaa

SEQ ID NO: 88 - DNA, 2211 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggcctggtgcttcctggctacaagtacctcggacccttcaacggactcgacaagggggagcccgtcaacgcggcggacgcagcggccctcgagcacgacaaggcctacgaccagcagctcgaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccagtagagcagtcaccccaagaaccagactcctcctcgggcatcggcaagaaaggccaacagcccgccagaaaaagactcaattttggccagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgttttttcccagtaacgggatcctgtttttggcaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctacagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 89 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacagcaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 90 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgcacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacttatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggagtaccagctgccgtacgtcctcggctctgcccaccagggctgcctgcctccgttcccggcggacgtcttcatgattcctcagtacggcaacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacatgggctatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacggcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 91 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccggaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcgtcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggagcccagagattcagtatacttccaactactacaaatctacaaatgtggactttgctgttaatactgagggtgtttactctgagcctcgccccattggcactcgttacctcacccgtaatctgtaa

SEQ ID NO: 92 - DNA, 2217 bp, Adeno-associated virus
atggttgccgatggttatcttccagattggctcgaggacaacctctctgagggcattcgcgagtggtgggacctgaaacctggagccccgaaacccaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagcttaaagcgggtgacaatccgtacctgcggtataatcacgccgacgccgagcttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgccagcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagccgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 93 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaatagcctcaccagcaccatccaggtgtttacggactcggaataccagctgccgtacgtcctcggctctgcccaccagggctgcctgcctccgttcccggcggacgtcttcatgattcctcagtacggctacctgactcccaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgtcttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacttgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 94 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgtgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaattcgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttaccccacccgtaatctgtaa

SEQ ID NO: 95 - DNA, 2214 bp, Adeno-associated virus
atggctgctgacggttatcttccagattggctcgaggacaacctctctgagggcattcgcgagtggtgggacctgaaacctggagccccgaaacccaaagccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaacctctcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcgactcatcaacaacaactggggattccggcccaagaagctcaacttcaagctcttcaacatccaagtcaaggaggtcacgacgaatgacggcgtcacgaccatcgctaataaccttaccagcacggttcaggtcttttcggactcggagtaccagctgccgtacgtcctcggctctgcccaccagggctgcctgcctccgttcccggcggacgtcttcatgattcctcagtacggctacctgactctgaacaatggcagccaatcggtgggacgttcatccttctactgcctggaatacttcccttctcaggtgctgagaacgggtaacaacttcaccttcagttacaccttcgaggacgtgcctttccacagcagctacgcgcacagccagagcctagaccggctgatgaatcccctcatcgaccagtacctgtattacctggctagaacacagagtaacccaggaggcacatctggcaatcgggaactgcagttttaccagggcgggccttccaccatggccgaacaagccaagaactggttacctggaccttgcttccggcaacaaagagtttccaaaacactggatcaaaacaacaacagcaactttgcttggactggtgccaccaaatatcacctgaacggcagaaactcattggtgaatcctggtgtcgccatggcaactcacaaggacgacgaggaccgctttttcccatccagcggagtcctgatttttggaaaaactggagcaaccaacaagactacattggaaaacgtgttaatgacaaatgaagaagaaattcgtcctactaatcctgtggccacagaagaatacgggatagtcagcagcaatttacaagcggccaatactgcagcccagacacaagttgtcaacaaccagggagccttacctggcatggtctggcagaaccgggacgtgtacctgcagggtcccatctgggccaaaattcctcacacagacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 96 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacacggctgggcgacagagtcatcaccaccagcacccggacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacgaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 97 - DNA, 2217 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaacctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgcggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 98 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaacctccagcagcgccctctagtgtgggatctggtacaatggccgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagctgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaagcactcctgttcctgcggatcctccaacagcgttcaaccaggccaagctgaattctttcatcacgcagtacagcaccggacaagtcagcgtggagatcgagtgggagctgcagaaggagaacagcaagtgctggaacccagagattcagtatacttccaactactacaaatctacaaatgtggactttgctgttaatactgagggtgtttactctgagcctcgccccattggcactcgttacctcacccgtaatctgtaa

SEQ ID NO: 99 - DNA, 2208 bp, Adeno-associated virus
atggctgccgatggttatcttccagattggctcgaggacaacctctctgagggcattcacgagtggtgggacccgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacccacaacaaccacctctacaagcaaatctccaacgggacctcgggaggcagcaccaacgacaacgtctacttcggctacagcaccccctgggggtattttgacttcaacagattccactgtcacttctcaccacgtgaccggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacggaaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 100 - DNA, 2217 bp, Adeno-associated virus
atggctgccgatggttatcttccagattggctcgaggacaacctctctgagggcattcgcgagtggtgggacctgaaacctggagccccgaaacccaaggccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgacccatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctaccctttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaagacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcaggtcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 101 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagttccaggagcgtctgcaagaagatacgtcttttgggggcaacctcgggcgagcagtcttccaggccaagaagcgggttctcgaacctctcggtctggctgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagagccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgggtgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatgacagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 102 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgtgtgggagctgcagaaggagaacagcaagcgcaggaacccagagattcagtatacttccaactactacaaatctacaaatgtggactttgctgttaatactgagggtgtttactctgagcctcgccccattggcactcgttacctcacccgtaatctgtaa

SEQ ID NO: 103 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatggcggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacggcaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgacgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 104 - DNA, 2208 bp, Adeno-associated virus
atggctgccgatggttatcttccagattggctcgaggacactctctctgaaggaataagacagtggtggaagctcaaacctggcccaccaccaccaaagctcgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccatcagcctgcgagaaagagattgaattttggtcagactggagacgcagactccgtacctgacccccagcctctcggacagccaccagcagcccccacaagtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcacggtcccacagtatggatacctcaccctgaacaacgggagtcaggcggtaggacgctcttccttttactgcctggagtactttccttctcagatgctgcgtactggaaacaaccttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaactacagttctgccaagtttgcttctttcatcacacagtattccacgggccaggtcagcgtggagattgagtgggagctgcggaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 105 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcgtctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 106 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagaggccggtagagcactctcctgcggagccagactcctcctcgggaaccggaaaagcgggccagcagcctgcaagaaaaagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacttgggccctgcccacctacaacaaccatctctacaagcaaatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggccagccacaaggacgatgaagaaaagttttttcctcagagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctgcagggcggcaacacacaagcagctaccgcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacagattctcatcaagaacaccccggtacctgcgaatccttcgaccaccttcagtgcggcaaagtttgcttctttcatcacacagtattccacggggcaggtcagcgtggagatcgagtgggagctgcagaaggagaacagcaaacgctggaatcccgagatccagtacacttccaactacaacaaatctgttaatgtggactttactgttgacactaatggcgtgtattcagagcctcgccccattggcaccagatacctgactcgtaatctgtaa

SEQ ID NO: 107 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactctacaagggagagccggtcgacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggccaaaaagagggttcttgaacctctgggcttggttggggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaataaccacctctacaagcaaatctccagccaatcaggagcctcaaacgacaaccactactttggctacagcaccccctgggggtattttgacttcaacagattccactgccacttttcaccacgtgaccggcaaagactcatcaacaacaactggggattccgaccaaaaagactcaacttcaagctctttaacattcaagtcaaagaggtcacgcagaatgacggtacgacgacgattgccaataaccttaccagcacggttcaggtgtttactgactcggggtaccagctcccgtacgtcctcggcttggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtggagatcgagtgggagctgcagaaggaggacagcaaacgctggaaccccgagatccagtacacttccaactataacaaacctgttaatgtggactttactgtggacactaatggtgtgtattcagagcctcgccccattggcaccagatacctgactcgtaatctgtaa

SEQ ID NO: 108 - DNA, 2208 bp, Adeno-associated virus
atggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactctacaagggagagccggtcaacgaggcagacgccgcggccctcgagcacgacaaggcctacgaccggcagctcgacagcggagacaacccgtacctcaagtacaaccacgccggcgcggagtttcaggagcgccttaaagaagatacgtcttttgggggcaacctcggacgagcagtcttccaggccaaaaagagggttcttgaacctctgggcttggttgaggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgaccaaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaacccttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaagactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtagagatcgagtgggagctgcagaaggagaacagcaaacgctggaaccccgagatccagtacacttccaactataacaaatctgttaatgtggactttactgtggacactaatggtgtgtattcagagcctcgccccattggcaccagatacctgactcgtaatctgtaa

SEQ ID NO: 109 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctgcaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactataacaaatctgttaatgtggactttactgtggacactaatggtgtgtattcagagcctcgccccattggcaccagatacctgactcgtaatctgtaa

SEQ ID NO: 110 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgaaagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggagcctgttaaaacggctccgggaaaaaagaggccggtagagcactctcctgtggagccagactcctcctcgggaaccggaaaagcgggccagcagcctgcgagaaaaagattgaattttggtcagactggagacgcagactccgtacctgacccccagcctctcggacagccaccagcagccccctctggtctgggatctactacaatggcttcaggcagtggcgcaccagtggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacagctggggattccgacccaaaagactcaacttcaagctctttaacattcaagtcaaagaggtcacgcagaatgacggtacgacgacgattgccaataaccttaccagcacggttcaagtgtttaccgactcggagtaccagctcccgtacgtcctcggctcggcgcatcaaggatgcctcccgccgttcccagcagacgtctttatggtcccacagtatggatacctcaccctgaacaacgggagtcaggcggtaggacgctcttccttttactgcctggagtactttccttctcagatgctgcgtactggaaacaactttcagttcagctacacctttgaagacgttcccttccacagcagctacgctcacagccagagtctggatcggctgctgaatcctctgatcgaccagtacctatattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacacggacgggcactttcatccttctccactaatgggaggttttgggctcaaacacccgcctcctcagatcatgatcaaaaacactcccgttccagccaatcctcctacaaacttcagttcttccaagtttgcttctttcatcacacagtattccacggggcaggtcagcgtggagatcgagtgggagctgcagaaggagaacagcaaacgctggaatcccgaaattcagtatacttccaactacaacaaatctgttaatgtggactttactgtggacactaatggtgtgtattcagagcctcgccccattggcaccagatacccgactcgtaatctgtaa

SEQ ID NO: 111 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggagaaaagaggccggtagagcactctcctgcggagccagactcctcctcgggaaccggaaaagcgggccagcagcctgcaagaaagagattgaattttggccagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggtattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcgtgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 112 - DNA, 2209 bp, Adeno-associated virus
atggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaat

SEQ ID NO: 113 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaggtacctcggacccttcaacggactcgacaagggagagccggtcaacgaggcagacgccgcggccctcgagcacgacaaggcctacgaccggcagctcgacagcggagacaacccgtacctcaagtacaaccacgtcgacgcggagtttcaggagcgtcttaaagaagatacgtcttttgggggcaacctcggacgagcagtcttccaggccaaaaagaggattcttgaacctctgggcctggttgaggaacctgttaaggcggctccgggagaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggcattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctccccccatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcgccagatacctgactcgtaatctgtaa

SEQ ID NO: 114 - DNA, 2208 bp, Adeno-associated virus
atggctgccgatggttatcttccagattggctcgaggacaccctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagataacccgtacctcaagtacaaccacgccgacgcggagtttcaggagcgccttaaagaggatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccggcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 115 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaaggagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcggcagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagacgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 116 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctgcaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtattttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctacctacctccagagcggcaacacacaagcagctacctcagatgtcaacacacaaggcgttcttccaggcatggtctggcaggacagagacgtgtacctgcgggggcccatctgggcaaagattccacacacggacggacattttcacccctctcccctcatgggcggatttggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 117 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacggcagcaggggtcttgtgcttcctgggtacaagtacctcggacccttcaacggactcgacaagggagagccggtcaacgaggcagacgccgcggccctcgagcacgacaaggcctacgaccggcagctcaacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagagaccggtagagcactctcctgcggagccagactcctcctcgggaaccggaaaagcgggccagcagcctgcaagaaagagattgaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccacaagcactcgaacctgggccctgcccacctacaacaaccacctctacaagcaaatctccagccaatcaggagcctcaaacgacaaccactattttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcggacgtcttcatggtcccacagtatggatacctcaccctgaacaacgggagtcaggcggtaggacgctctcccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggaccaccaatcccgtggctacggagcagtacgggactgtgtcaaataatttgcaaaactcaaacactggtccaactactggaactgtcaatcaccaaggagcgttacctggtatggtgtggcaggatcgagatgtgtaccttcagggacccatttgggccaagattcctcacaccgatggacactttcatccttctccactgatgggaggttttggactcaaacacccgcctcctcagattatgatcaaaaacactcccgttccagccaatcctcctacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacaataatggcgtgtactcagagcctcgccccattggcaccagatacctgactcgtaatctgtaa

SEQ ID NO: 118 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtatttcgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgccttccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacggccaaagtctggaccgtctcatgaatcctctcatcgaccagtacctgtattacttgagcagaacaaacactccaagcggaaccaccacgatgtccaggcttcagttttctcaggccggagcaagtgacgttcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcgtctttggaaaacaagactcgggaaaaactaatgtggacattgaaaaggttatgattacagacgaagaggaaatcaggaccaccaatcccgcggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgtttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 119 - DNA, 2208 bp, Adeno-associated virus
atggctgccgatggttatcttccagattggctcgaggacactctctctgaaggaataagacagtggtggaaactcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttctggaacctctgagcctggttgaggagcctgttaagacggctccgggaaaaaagaggccggtagagcactctcccgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcaggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtcgggcaagacagagacgtgtacctgcaggggcctacttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 120 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagggtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggcccagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 121 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgcggcctggtttgaggaaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctggacgacagagtcatcgccaccagcacccgaacctgggccctgcccacatacaacaaccacctctacaagcaaatctccagccaatcaggagcctgcaacgacaaccactactttggctacagcaccccctgggggtattttgacttcaacagattccactgccacttttcaccacgtgactggcaaagactcatcaacagcaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcccgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcactgccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaataacaactgcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggcccaccaatcccgtggctacggagcagtacgggactgtgtcaaataatttgcaaaactcaaacactggtccaactacaggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaagcactcccgttccagccaatcctcccacaaacttcagttctgccaagtttgcttcttccatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 122 - DNA, 2211 bp, Adeno-associated virus
atggctgccgatggttatcttccagattggctcgaggacactctctctgaaggaataagacagtggtggaagctcaaacctggccccccaccaccaaagcccgcagagcggcataaggacgacagcaggggtcttgtgcttcctgggtacaagtacctcggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggttcacagcccgctaaaaagaaactcaatttcggtcagactggcgacacagagtcagtccccgaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaggccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtccggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctaatgggagggtttggaatgaagcacccgcctcctcagatcctcatcaaaaacacacctgtacctgcggatcctccaacggctttcaataaggacaagctgaactctttcatcacccagtattctactggccaagtcagcgtggagattgagtgggagctgcagaaggaaaacagcaagcgctggaacccggagatccagtacacttccaactattacaagtctaataatgttgaatttgctgttagtactgaaggtgtatatagtgaaccccgccccattggcaccagatacctgactcgtaatctgtaa

SEQ ID NO: 123 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggttcacagcccgctaaaaagaaactcaatttcggtcagactggcgacacagagtcagtccccgaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatgggagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagcgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctaatgggagggtttggaatgaagcacccgcctcctcagatcctcatcaaaaacacacctgtacctgcggatcctccaacggctttcaataaggacaagctgaactctttcatcacccagtattctactggccaagtcagcgtggagattgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 124 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcctttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgagagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 125 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtaccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 126 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgttcggaaaacagggtgctggaagagacaatgtggactacagcagcgttatgctaaccagcgaagaagaaattaaaaccactaaccccgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 127 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcggactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagttatcaccaccagcacccgaacctgggccctgcccacctacaacaaccacctctacaagcaaatctccaacgggacctcgggaggcagcaccaacgacaacacctactttggctacagcaccccctgggggtatcttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcgccagcaccatccaggtgtttacggactcggaataccagccgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcgggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctactgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcgcgcagtacagcaccggacaagtcagcgtggagatcgagtgggagctgcagaaggagaacagcaagcgctggaacccagagattcagtatacttccaactactacaaatctacaaatgcggactttgctgttaatactgagggtgtttactctgagcctcgccccattggcactcgttacctcacccgtaatctgtaa

SEQ ID NO: 128 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggagcctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcgtcaacaacaaccggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 129 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgagctttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattctgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 130 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtccggttgaggaagctgctaagacggctcctggaaagaagagaccggtagaaccgccacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccgtcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgttggaacccagagattcagtacacttcaaactactacaaatctacaaatgtggactttgctgtcaatacagagggaacttattctgagcctcgccccattggtactcgttacctcacccgtaatctgtaa

SEQ ID NO: 131 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagcggctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaagcaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggacttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 132 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgccttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctctccacagcagctacgcgcacagccagagcctggaccggctgatgaatcctctcatcgtccaatacctgtattacctgaacagaactcaaaatcagtccggaagtgcccaaaacaaggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccagcgttgattttactgtggacaacaatggactttatactgagcctcgccccattggcacccgttaccttacccgtcccctgtaa

SEQ ID NO: 133 - DNA, 2211 bp, Adeno-associated virus
atggctgccgatggttatcttccagattggctcgaggacactctctctgaaggaataagacagtggtggaagctcagacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagcgggttctcgaacctctcggtctggttgaggaaggcgctgagacggctcctggaaagaaacgtccggtagagcagtcgccacaagggccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacccgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaaggtagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 134 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgcctcccgccgttcccagcagacgtcttcatggtgccacagtatggataccccaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccgtggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 135 - DNA, 2211 bp, Adeno-associated virus
atggctgccgacggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgggcagtcttccaggccaagaagcgggttctcgaacctctcggtctggttgaggaaggcgctaagacggctcctggaaagaaacgtccggtagagcagtcgccacaagagccagactccccctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcactgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggccgcctccctccgttcccggcggacgtgttcatgattccgcaatacggctacctgacgctcaacaatggcagccaagccgtgggacgttcatcctcttactgcctggaatatttcccttctcagatgctgagaacgggcaacaactttaccttcagctacacctttgaggaagtgcctctccacagcagctgcgcgcacagccagagcctggaccggctgatgaatcctctcatcgaccaatacctgtattacctgaacagaactcaaaatcagtccggaagtgcccaaaacagggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccgcaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 136 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacagtcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggctccagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 137 - DNA, 2211 bp, Adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggccagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtacttcaacgggggccagcaacgacaaccactacttcggctacggcaccccctgggggtattttgatttcaacagattccactgccacttttcaccacgtgactggcagcgactcatcaacaacaattggggattccggcccaagagactcaacttcaaactcttcaacatccaagtcgaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaacacaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcaccgctgtggcctcacacaaagacgacgaagacaagttctttcccatgagcggtgtcatgatttttggaaaagagagcgccggagcttcaagcactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 138 - DNA, 2208 bp, Adeno-associated virus
atggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaa

SEQ ID NO: 139 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgtcaagacggctccaggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcggctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtacggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 140 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaatcggcattgcgattccacatggatgggcgacagagtcatcaccaccagcacccgaacctgggccctgcccacctacaacaaccacctctacagacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgagcaacgggagtcaggcagtaggacgctcttcattttactgcccggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacctaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatttgtaa

SEQ ID NO: 141 - DNA, 2205 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 142 - DNA, 2205 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggctctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccgcttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagggtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcggagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcggggacccatttgggccaagattcctcacgccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 143 - DNA, 2205 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtgctttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 144 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 145 - DNA, 2205 bp, Adeno-associated virus
atggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 146 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacgaccacgccgacgcggagtttcaggagcgccttaaagaagatacgtcttttgggggcaacctcggacgagcagtcttccaggcaaaaaagagggttcttgaacctctgggcctggttgaggagcctgttaagacggctccgggaaaaaagaggccggtagagcactctcctgtggagccagactcctcctcgggaaccggaaaagcgggcaaccagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgatggcgccgacggagtgggtaattcctcgggaaattggcattgcgattccacatggatgggcgacagagtcatcaccaccagcacccgaacctgggctctgcccacctacaacaaccatctgtacaagcagatttccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcagagaggtcacgcagaatgatggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtacttcccttctcagatgctgcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggatcagtctaggaactggcttcctggaccctgttaccgccagcagcgagtatcaaagacatctgcggacaacaacaacagtgaatactcgtggattggagctaccaagtaccacctcaatggcagagactctctggtgaatccgggcccggcaatggccagccacaaggacgatgaagaaaagttttttcctcagagcggggttctcatctttggaaaacaaggatcagagaaaacaaatgtggacattgaaaaggtcatgattacagacgaagaggaaatcagaaccaccaatcccgtggccacggagcagtatggttctgtatctaccaacctccagagcggcaacacacaagcatctactgcagatgtcaacacacaaggcgttcttccaggcatggtctggcaggacagagacgtgtacctgcaggggcctatctgggcaaagattccgcacacggacggacattttcacccctctcccctcatgggcggattcggacttaaacaccctcctccacagattctcatcaaaaacaccccggtacctgcgaatccttcgaccaccttcagtgcggcaaagtttgcttccttcatcacacagtattccacggggcgggtcagcgtggagatcgagtgggagctacagaaggagaacagcaaacgctggaatcccgagatccagtacacttccaactacaacaaatctgttaatgtggactttactgtggacactaatggtgtgtattcagagcctcgccccattggcaccagatacctgactcgtaatctgtaa

SEQ ID NO: 147 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccgcatggctgggcgacagagtcatcaccaccagcacccgaccctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 148 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcactctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcaattcagctacacttttgaagacgtgcctttccacagcagctacgctcacagccagagtctggatcggctgatgaatcctctggtcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 149 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcaccctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaaccggctgcctggaccttgctacagacagcagcgtctgtcaaagcaggcaaacgacaacaacaacagcaactttccctggaccgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactggtgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 150 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacagcggagacaacccgtaccccaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaagcagatttccagccaatcaggagcctcaaacgacaaccactactttggctacagcaccccttgggggtattttgacttcaacagattccactgccacttttcgccacgtgactggcaaagactcatcaacaacaattggggattccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcatcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccaggtacctgactcgtaatctgtaa

SEQ ID NO: 151 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacggcggagacaacccgtacctcaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcttgcggagccagactcctcctcgggaaccggaaaagcgggccagcagcctgcaagaaggagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaggcagatttccagccaatcaggagcctcaaacgacaaccactactttggctacagcaccccttgggggtattttgacttcaacagattccactgccacttttcgccacgtgactggcaaagactcatcaacaacaattggggatcccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcgtcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccagatacctgactcgtaatctgtaa

SEQ ID NO: 152 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccgcgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccgagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctgcgcacacagccagagctcggaccgactgatgaatcctctcatcgaccagtacctgtactacttatccagaactcggtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 153 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 154 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgagggacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtatcacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 155 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacaacagcaggggtcttgtgcttcctgggtacaagtacctcggaccctccaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctgcagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtacccgctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtaccggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagccttgccccattggcaccagatacctgactcgtaatctgtaa

SEQ ID NO: 156 - DNA, 2208 bp, Adeno-associated virus
atggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggagcctgttaagacggctccgggaaaaaagaggccggtagagcactctcctgcggagccagattcctcctccggaactggaaagtcgggccaacagcctgcaagaaagagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccatctgtacaagcagatttccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgctgcgtactggaaacaactttaccttcagctacacctttgaagacgttcctttccacagcagctacgctcacagccaaagtctggaccgtctcatgaatcctctcatcgaccagtacctgtattacttgagcagaacaaacacgccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttcctggcatggtctggcaggacagagacgtgtacctgcaggggcccatttgggcaaagattccccacacggatggacactttcacccttctcctcttatgggaggatttggactgaagcaccctcccccgcagattctcatcaagaataccccggtacctgcaaatccttcgaccaccttcagtgcggcaaagtttgcttctttcatcacacagtactccacggggcaggtcagcgtggagatagagtgggagctgcagaaggagaacagcaaacgctggaatcccgagatccagtatacttccaactataacaaatctgttaatgtggactttactgtggacactaatggtgtgtattcagagcctcgccccattggcaccagatacctgactcgtaatctgtaa

SEQ ID NO: 157 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcacaaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcgaagtttcaggagcgtcttaaagaagatacgtcttttgggggcaacctcggacgagcagtcttccaggccaaaaagaggattcttgaacctctgggcctggttgaggagcctgttaagacggctccgggaaaaaagaggccggtagagcactctcctgcggagccagattcctcctccggaactggaaagtcgggccaacagcctgcaagaaagagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccatctgtacaagcagatttccagccagtctggagccagcaacgacaaccactactttggctacagcaccccctgggggtattttgacttcaacagattccactgccacttctccccacgtgactggcaaagactcatcaacaacaactggggattccggcccaagagactcggcttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgctgcgtactggaaacaactttaccttcagctacacctttgaagacgttcctttccacagcagctacgctcacagccaaagtctggaccgtctcatgaatcctctcatcgaccagtacctgtattacttgagcagaacaaacacgccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacactgaaaaggtcatgattacagacgaagaggaaatcaggaccaccaatcccgtggctacggagcagtacggtgctgtatctaccaaccttcaaagcggcaacacacaagcagctacctcagatgtcaacacacaaggcgttcttcctggcatggtctggcaggacagagacgtgtacctgcaggggcccatctgggcaaagattccccacacggatggacactttcacccttctcctcttatgggaggatttggactgaagcaccctcccccgcagattctcatcaagaataccccggtacctgcgaatccttctaccaccttcagtgcggcaaagtttgcttctttcatcacacagtactccacggggcaggtcagcgtggagatcgagtgggagctgcagaaagaaaacagcaaacgctggaaccccgagatccagtacacttccaactacaacaagtctgttaatgtggactttactgtggacactaatggcgtgtattcagagcctcgccccattggcacaagatacctgactcgtaatctgtaa

SEQ ID NO: 158 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcacaaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggagcctgttaagacggctccgggaaaaaagaggccggtagagcactctcctgtggagccagactcctcctccggaactggaaagtcgggccaacagcctgcaagaaagagattgaattttggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacctgggctctgcccacctacaacaaccatctgtacaagcagatttccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgctcacagccaaagtctggaccgtctcatgaatcctctcatcgaccagtacctgtattacttgagcagaacaaacacgccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccaccttaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctaccgcagatgtcaacacacaaggcgttcttcctggcatggtctggcaggatagagacgtgtacctgcaggggcccatctgggcaaagattccacacacagacggacattttcacccctctcccctcatgggcggatttggacttaaacaccctcctccacagattctcatcaagaataccccggtacctgcgaatccttcgaccacctttagtgcggcaaagtttgcttctttcatcacacagtattccacgggacaggtcagcgtggagatagagtgggagctgcagaaggagaacagcaaacgctggaatcccgagatccagtatacctctaactacaacaagtctgttaatgtggactttactgtggacactaatggcgtgtattcagagcctcgccccattggcaccagatacctgactcgtaatctgtaa

SEQ ID NO: 159 - DNA, 2181 bp, Adeno-associated virus
atgtcgtttgttgatcaccctccagattggttagaagaagttggtgaaggccttcacgagtttttggagctcgaagctggcccacccaaaccgaagcccaaccagcagaagcaggacaacgcccgtggtcttgtactgcctggatataattatctgggacccttcaacggactcgacaagggagagcccgtcaaccgagcggacgctgttgcgcgagagcacgacatctcgtacaacgagcagctccaggcgggagacaacccctacctcaagtacaaccacgcggacgccgagtttcaggagaagctcaaggacgacacctcctttgggggcaacctcggaaaggcaatctttcaggccaagaaaagggttctcgaaccttttggcctggttgaggcacctgttaagacggctccagccaagaagcggccgatagagaagtctccggcggaaccgagctcttcgaagggcatcggcaaggcgggccagcagcctgcgaggaagcgactcaactttggtcagactggagacaccgactccgccgctgacccccagcctctcggagaaccaccagcagccccctctggtctgggaactggtacgatggcttcaggcagtggcgcaccaatggcagacaataacgaaggcgccgacggagtgggtaatgcctcgggaaattggcattgcgattccacatggctgggcgaccgagtcatcaccaccagcacccgcacctgggccctgcccacctacaacaaccatctctacaagcaaatctccagccagtctggagccaacaacgacaaccactactttggctacagcaccccctgggggtactttgacttcaaccgcttccactgccacttctccccgcgagactggcagcggctcatcaacaacaactgggggttccggcccaagcgactcaacttcaagctcttcaacatccaagtcaaggaggtcactcagacggacggcacgaagaccatcgccaataaccttaccagcacggttcaggtctttgcggactcggagtaccagctcccatacgtcctcggatcggcgcaccagggctgcttcccaccgttcccggcggacgtctttatggtcccgcaatacgggtacttgacgctgaacaacggcagccaggccatgggccgctcttccttctactgcctggagtactttccatcgcagatgctgcgaacagggaacaacttcacgttcagctacaccttcgaggacgtgcccttccacagcagctacgcccacagccagagcctggaccggctcatgaatcctctcatcgaccagtatctatactacttgagcaagacacagaacggcttgggcttttctcaggcgggacacaacagcatgcgggatcagtctaggaactggctgccggggccttgcttcagacagcagcgaatatcgaaaacacctacgcaaaataatactggagactttgcgtggacaggaactacaagatatcacctcaacggcagaaactcggcgatgaatccgggtccggccatggccagccacaaggatgacgaggaaagattctttcctcaaaatggtgtactcatctttggaaaagaagatgcagaaaaaaacaatgcggtgcttgacaaagtgatcatcactgacgaggaggaaatcagaaccacgaaccctgtggccacgggagaatacgggctcgttgctaccaacttccaaaacaatacaacagcagcagatacagagatggtcaacgcacagggcatcctacccggcatggtgtggcaagaccgagatgtgtatctgcagggacccatctgggctaagattccccacacggacggacactttcatccctcgccgctcatgggcgggttcggcctcaagcgcccgcctccgcaaatcctcattaagaacactcccgtaccagcggatcccgccacgaccttcaacccggcgaagctagcgtccttcatcacgcagtactccacgggccaggtcagcgtggaaatcgagtgggagcttcagaaggagaacagcaagcgctggaaccccgaggtccagtacacgtccaactacaacaagtccgtcaacgtggaatttacagtggacaacaacggcgtgtattcggaaccgcgcaccatcggcacccgctaccttactcgtaatctgtaa

SEQ ID NO: 160 - DNA, 2181 bp, Adeno-associated virus
atgtcgtttgttgatcaccctccagattggttagaagaagttggtgaaggccttcacgagtttttggagctcgaagctggcccacccaaaccgaagcccaaccagcagaagcaggacaacgcccgtggtcttgtactgcctggatataattatctgggacccttcaacggactcgacaagggagagcccgtcaaccgagcggacgctgttgcgcgagagcacgacatctcgtacaacgagcagctccaggcgggagacaacccctacctcaagtacaaccacgcggacgccgagtttcaggagaagctcaaggacgacacctcctttgggggcaacctcggaaaggcaatctttcaggccaagaaaagggttctcgaaccttttggcctggttgaggcacctgttaagacggctccagccaagaagcggccgatagagaagtctccggcggaaccgagctcttcgaagggcatcggcaaggcgggccagcagcctgcgaggaagcgactcaactttggtcagactggagacaccgactccgccgctgacccccagcctctcggagaaccaccagcagccccctctggtctgggaactggtacgatggcttcaggcagtggcgcaccaatggcagacaataacgaaggcgccgacggagtgggtaatgcctcgggaaattggcattgcgattccacatggctgggcgaccgagtcatcaccaccagcacccgcacctgggccctgcccacctacaacaaccatctctacaagcaaatctccagccagtctggagccaacaacgacaaccactactttggctacagcaccccctgggggtactttgacttcaaccgcttccactgccacttctccccgcgagactggcagcggctcatcaacaacaactgggggttccggcccaagcgactcaacttcaagctcttcaacatccaagtcaaggaggtcactcagacggacggcacgaagaccatcgccaataaccttaccagcacggttcaggtctttgcggactcggagtaccagctcccgtacgtcctcggatcagcgcaccagggctgcttcccgccgttcccggcggacgtcttcatggtcccgcagtacgggtatttgacgctgaacaacggcagccaggcgatgggtcgctcgtccttctactgcctggagtactttccgtcgcagatgctgcggacggggaacaacttcacgttcagctacaccttcgaggacgtgcccttccacagcagctacgcgcacagccagagtctggaccggctcatgaacccactcatcgaccagtacctgtactacctaagcaagacaaatggcggtctaggattttcccaagcgggacccaacagcatgcgcgaccagtccaggaattggctgccgggaccctgcttcagacaacaacggatttcaactgtacctacacaaaataacaacggagacttttcgtggacgggagccacaaagtatcatctcaatggaagaaactcagcaatgaatcccggcccggccatggccagccacaaagacgacgaacacagattcttccctcagaacggtgtgctcatctttggaaaacagggcgcagacaagacaaatgcgatactagaaaaagtgatcgttacagacgaagaggagattaggacaacaaatcctgtagccacggaggagtatgggtttgtcgccactaatctacaaagctcggcagaaacagccgagaccgaaagagtcaacgcgcaaggcatcctccctggcatggtgtggcaagaccgagatgtgtatctgcaggggcccatctgggccaagatcccccacaccgacggacacttccgcccctcaccactcatgggaggattcggcctcaagcacccgcctccgcagatcctcatcaagaacacgcctgtgccttcgaatcctccagagacgttcaacccggaaaagctcaattctttcataactcaatattctacgggccaggtcagcgtggagatcgagtgggagctgcagaaggagaacagcaagcgctggaaccccgaggtccagtacacgtccaactacaacaagtccgtcaacgtggaatttacagtggacaacaacggcgtgtattcggaaccgcgcaccatcggcacccgctaccttactcgtaatctgtaa

SEQ ID NO: 161 - DNA, 2151 bp, Adeno-associated virus
atgtcgtttgttgatcaccctccagattggcttgaggagattggtgagggtctaaaggagtttttgggactcgaacctggcccacccaaaccgaagcccaaccagcagaagcaagacaacgcccgtggtcttgtactgcctggatataattacctgggacccggcaacggtctcgaccgcggagaacctgtcaaccgggccgacgaggtcgcgcgagagcacgacatctcgtacaacgagcagctccaggcgggagacaacccctacctcaagtacaaccacgcggacgccgagtttcaagagaagctcgcggacgacacctccttcgggggcaacctcggcaaggcagtctttcaggccaagaaaagggttctcgaaccttttggcctggttgaggatcctgttaagacggctgctaaaggcgagcggatagacgaccactatcccaagaagaagaaggctcgggttgaagaaaccgaagctggaaccagcggagcccagcagctgcagatcccagcccaaccagcctcaagtttgggagctgatacaatgtctgcgggaggtggcagcccactgggcgacaataaccaaggcgccgatggagtgggcaatgcctcgggagattggcattgcgattccacatggatgggggacagagtcatcaccaagtccacccgaacctgggtgctgcccagctacaataaccacctgtacaaagagatccacaacaacggggtcgacggcagcaccgccaacgcttactttggatacagtaccccctgggggtactttgacttcaaccgcttccacagccactggagccctcgagactggcagcgactcatcaacaactactggggcttcagaccccggtccctcaaggtcaagattttcaacatccaagtcaaagaggtcacggtgcaggacaacaccaccaccatcgccaacaacctcacctccaccgtccaagtgtttacggacaacgactaccagctgccgtacgtcatcggcaacgggaccgaggggtgtctaccggccttccctccgcaggtctttacgctgccgcagtatggctacgcgacgctgaatcgcaacaatagcgaaaatcccaccgagcgaagcagcttcttctgtctggagtactttcccagcaagatgctgcggacgggcaacaactttgagttcacatacagcttcgaggaggtacccttccactgcagcttcgcgcccagccaaaacctcttcaaactggctaacccgttggtggatcagtacctttaccgcttcgtgagcacggacacctccggtgccgtccagttcaaaaagaacctggcgggcagatacgccaacacctacaagaactggttcccaggacccatgtgccgaacccagggctggtacacaggaacgggtatatataacaacaaaggcgctaccagctttaacacctcaaacagaatggacctagagggagccagttatcaagtgcctccccagcccaacgggatgacaaacacggttcaggacagcaacctttacgcgctggaaaacaccatgatttttaacgcacaaaacgccaccccgggaacgaatacaacgtatccggaggagaaccttttgataaccagtgagagcgagactcaacccgtgaacagagtggcttacagctccggaggacaaatagccaacaacaatcagaataccaacacggctcctactgcaggaacctacaaccaccaggaaatactacctggcagcgtgtggatggacagggacgtgtacctccagggtcccatctgggccaagatcccagagacaggggcacactttcatccttctccagccatgggcgggttcggactcaaatacccgcctcccatgatgctaatcaagaacacgccagtgcccggaaacatcaccaccttctcggacgtgcccgtccaaagttttattacccagtacagcaccggacaagtcaccgtggagatggagtgggagctcaagaaggaaaactctaagaggtggaaccccgagatacagtacaccaacaactacaacaaccctacgttcgtggactttgctccagacacagaaggagaatacaggaccactagggctattggaacccgctaccttacccgacctctgtaa

SEQ ID NO: 162 - DNA, 2184 bp, Adeno-associated virus
atgtcgtttgttgatcaccctccagattggttggaagaggttggtgaaggccttcacgagtttttggagctcgaagctggcccacccaaaccgaagcccaaccagcagaagcaggacaacgcccgtggtcttgtactgcctggatataattatctgggacccttcaacggactcgacaagggagagcccgtcaaccgagcggacgctgttgcgcgagagcacgacatctcgtacaacgagcagcttcaggcgggagacaacccctacctcaagtacaaccacgcggacgccgagtttcaggagaagctcaaggacgacacctcctttgggggcaacctcggaaaggcaatctttcaggccaagaaaagggttctcgaaccttttggcctggttgaagcgcctgttaagacggctccagccaagaagcggccgatagagaagtctccggcggaaccgagctcttcgaagggcatcggcaaggcgggccagcagcctgcgagaaagcggctcaactttggtcagactggagacaccgactccgccgctgacccccagcctctcggagaaccacccgcagccccctctggtctgggaactggtacgatggcttcaggcggtggcgcaccaatggcagacaataacgaaggcgccgacggagtgggtaatgcctcgggaaattggcattgcgattccacatggctgggcgaccgagtcatcaccaccagcacccgcacctgggccctgcccacctacaacaaccacctctacaagcaaatctcctctagcaattacggagccaacaacgacaaccactactttggctacagcaccccctgggggtattttgacttcaaccgtttccactgccacttctctccgcgagactggcagcggctcatcaacaacaactgggggttccggcccaagcgactcaacttcaagctgttcaacatccaagtcaaggaggtcacagaaacggacggcacgaagacgatcgccaataaccttaccagcacggttcaagtctttgcggactcggagtaccagctgccgtatgtcctcggctcggcacaccagggctgcttcccgccgttcccagcggacgtctttatgatcccacaatacggatacctgacgctgaacaacggcagccaggcgatgggtcgctcttccttctactgcctggaatactttccgtcgcagatgctgcggacgggaaacaacttcacgttcagctacacctttgaggacgtgcccttccacagcagctacgcgcacagccagagcctggaccggctgatgaacccgctcatcgaccagtacctgtactacctgagcaagacagccggtggtctggcgttttctcaagcagggcccaccaccatgcggaaccagtccaggaactggctcccgggaccctgcttccgacagcagcgagtttcagaaagatccacagaaaacaacaacggagacttctcgtggacagggaccacgagataccatcttaacggtagagactcggcgatgaatccgggcccggccatggccagtcacaaggacgacgaggacagattctttccgcaaaacggcgtgctcatctttggaacaccgaacgctactgcaagcaatgcacctctagagaatgtactgatcaccgatgaggaggaaatcagaactacgaaccctgtagccacggaagagtacgggatcgttgctaacaacaaacaggacagcagtacacaggcgacgaccgcgattgtcaacgcacaaggcatactgcccggcatggtgtggcaggatcgagatgtgtacctgcaggggcccatctgggccaagatcccccacacggatggacacttccacccatcaccgctcatgggcgggtttggccttaagcatccacctccgcagatcctcatcaagaacacgcctgtgccgtcgaaccctccagaaaagttcacccaggaaaaactaaatgccttcatcacacagtactcgacgggccaggtcagcgtggagatcgagtgggagctgcagaaggagaacagcaagcgctggaacccagaggtccagtacacgtccaactacaacaagtccgtcaacgtggactttactgtggacaccaacggcatgtactcggagccccgcactatcggcacccgctacctcacccgcaacctgtaa

SEQ ID NO: 163 - DNA, 201 bp, Adeno-associated virus
gcgattcccaatggttggacgacgcagtcgtcacccgatcaacaagaacctgggtgctccccagctacaacaaccacctctacaagagaatcactgggtcgaccagcgacgtcaacaaccggtactttggattcagtactccctggggatactttgacttcaaccgcttccactgtcacttctcacctcgagactggcagc

SEQ ID NO: 164 - DNA, 201 bp, Adeno-associated virus
gcgattcccaatggctggataacgcagtcgtcacccgatccacccgaacctgggtgctccccagctacaacaaccacctctacaaaaagatcgccggaaccggaaccgaccccaacaacaactactttggattcagcaccccgtggggatactttgactttaaccgcttccactgccacttctcccctcgagactggcaga

SEQ ID NO: 165 - DNA, 201 bp, Adeno-associated virus
gcgattcccaatggctggataacgcagtcgtcactcgatccacaagaacctgggtgctccccagctacaacaaccacctctacaaaaagatcgccggatccggaaccgaccccaacaacaactactttggattcagcactccgtggggatactttgactttaaccgcttccactgccacttctcccctcgagactggcaga

SEQ ID NO: 166 - DNA, 2208 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctg

SEQ ID NO: 167 - DNA, 2208 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctcttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctg

SEQ ID NO: 168 - DNA, 2208 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctcttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctg

SEQ ID NO: 169 - DNA, 2205 bp, Adeno-associated virus
atggctgccgatggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaatccctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttg

SEQ ID NO: 170 - DNA, 2184 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctg

SEQ ID NO: 171 - DNA, 2184 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaagggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctg

SEQ ID NO: 172 - DNA, 2205 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggcccagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctg

SEQ ID NO: 173 - DNA, 2208 bp, Adeno-associated virus
atggctgccgatggttatcttccagattggctcgaggacactctctctgaaggaataagacagtggtggaagctcagacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagggccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaaggtagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 174 - DNA, 2208 bp, Adeno-associated virus
atggctgccgatggttatcttccagattggctcgaggacactctctctgaaggaataagacagtggtggaagctcagacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagggccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagacagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 175 - DNA, 2208 bp, Adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggccagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtacttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaacacaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcaccgctgtggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 176 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtccccggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctgatcaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctg

SEQ ID NO: 177 - DNA, 2187 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgcctgcaagaagatacgtcatttgggggcaacctcgggcgagcagtcttccaggccaagaagcgggttctcgaacctctcggtctggttgaggaaggcgctaagacggctcctggaaagaagagacccatagactctccagactcctccacgggcatcggcaaaaaaggccagcagcccgctaaaaagaagctcaattttggtcagactggcgactcagagtcagtccccgaccctcaacctcttggagaacctccagcagcgccctctagtgtgggatctggtacaatggctgcaggcggtggcgcaccaatggcagacaataacgaaggtgccgacggagtgggtaatgcctcaggaaattggcattgcgattccacatggctgggcgacagagtcatcaccaccagcaccagaacctgggccctccccacctacaacaaccacctctacaagcaaatctccagcagcagctcaggagccaccaatgacaaccactacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacaacgaatgacggcgtcacgaccatcgctaataaccttaccagcacggttcaggtcttctcggactcggaataccagctgccgtacgtcctcggctctgcgcaccagggctgcctgcctccgttcccggcggacgtcttcatgattcctcagtacggctacctgactctgaacaacggcagccaatcggtgggccgttcctccttctactgcctggaatatttcccctctcaaatgctgagaacgggcaacaactttgagttcagttacagcttcgaggacgtgcctttccacagcagctacgcgcacagccagagcctagaccggctgatgaaccctctcatcgaccagtacctgtactacctggcccggacccagagcaccacgggttccaccagggaactgcaatttcatcaagctgggcccaatactatggccgagcagtcaaagaactggctgcctggaccctgctataggcaacagagactgtcaaagaacttggactttaacaacaacagcaattttgcctggactgctgccactaaatatcatctgaatggcagaaactctttgaccaatcctggcattcccatggcaaccaacaaggatgatgaggaccagttctttcccatcaacggggtactggtttttggcaagacgggagctgccaacaaaactacgctggaaaacgttctgatgaccagcgaggaggagatcaagaccactaaccctgtggctacagaagaatacggtgtggtctccagcaacctgcagtcgtctacagccgggcctcaatcacagactatcaacagccagggagcactgcctggcatggtctggcagaaccgggacgtgtatctgcagggtcccatctgggccaaaattcctcacacggatggcaactttcacccgtctcctctgatgggcggttttggactcaaacacccgcctccacagatcctgatcaaaaacacacctgtacctgctaatcctccggaggtgtttactcctgccaagtttgcctccttcatcacgcagtacagcaccggacaagtcagcgtggaaatcgagtgggagctgcagaaagaaaacagcaagcgctggaacccagaaattcagtatacttccaattatgccaagtctaataatgttgaatttgctgtgaaccctgatggtgtttatactgagcctcgccccattggcactcgttacctcacccgtaatctg

SEQ ID NO: 178 - DNA, 2214 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgataacttgcagcaaaccaatacggggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctg

SEQ ID NO: 179 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaaggccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctg

SEQ ID NO: 180 - DNA, 2211 bp, Adeno-associated virus
atggctgccgatggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctg

SEQ ID NO: 181 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgtgtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctg

SEQ ID NO: 182 - DNA, 2208 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgaggaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctg

SEQ ID NO: 183 - DNA, 2199 bp, Adeno-associated virus
atggctgccgatggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgcctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgagaaggtgccgttccactcaatgtatgctcacagccagagcctggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaagaagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgctggaatcctgaagtgcagtttacttcaaactatgggaaccagtcttctatgttgtgggctcccgatacaactgggaagtatacagagccgcgggttattggctctcgttatttgactaatcatttg

SEQ ID NO: 184 - DNA, 1338 bp, Adeno-associated virus
gacttcaaccgcttccacagccacttctcgccgcgagactggcagcggctcatcaacaacaactgggggttccggcccaagcgactcaacttcaagctgttcaacatccaagtcaaggaagttacggacacggacggcacgaagaccatcgccaataaccttaccagcacggttcaggtctttgcggattcggagtaccagctcccgtacgtcctcggatcagcgcaccagggctgcttcccgccgttcccggcggacgtcttcatggtcccgcagtacgggtatttgacgctgaacaacggcagccaggcgatgggtcgctcgtccttctactgcctggagtactttccgtcgcagatgctgcggacggggaacaacttcacgttcagctacaccttcgaggacgtgcccttccacagcagctacgcgcacagccagagtctggaccggctcatgaacccactcatcgaccagtacctgtactacctaagcaagacaaatgacggtctaggattttcccaagcgggacccaacagcatgcgcgaccagtccaggaattggctgccgggaccctgcttcagacaacaacggatttcaactgtacctacacaaaataacaacggagacttttcgtggacgggagccacaaagtatcatctcaatggaagaaactcagcaatgaatcccggcccggccatggccagccacaaagacgacgaacacagattcttccctcagaacggtgtgctcatctttggaaaacagggcgcagacaagacaaatgcgatactagaaaaagtgatcgttacagacgaagaggagattaggacaacaaatcctgtagccacggaagagtatgggtttgtcgccactaatctacaaagctcggcagaaacagccgagaccgaaagagtcaacgcgcaaggcatcctccctggcatggtgtggcaagaccgagatgtgtatctgcaggggcccatctgggccaagatcccccacaccgacggacacttccacccctcaccactcatgggaggattcggcctcaagcacccgcctccgcagatcctcatcaagaacacgcctgtgccttcgaatcctccagagacgttcaacccggaaaagctcaattctttcataactcaatattctacgggccaggtcagcgtggagatcgagtgggagctgcagaaggagaacagcaagcgctggaaccccgaggtccagtacacgtccaactacaacaagtctgttaatgtggacttcaccgtggacaccaacggtgtgtactcggaaccgcgcaccatcggcacccgataccttacccgcaacctgtaa

SEQ ID NO: 185 - DNA, 1500 bp, Adeno-associated virus
gattccacatggctggacaagcgagtcattaccaagtccacccgaacctggagcctgcccacctacaacaaccacctctacaacaaaatcacctccaccgcagcaaatggagacggaacctggttcggattcagcactccatggggatactttgacttcaaccgcttccactgccatttctcaccccgagactggcagcgactcatcaacaacaactggggcatccggcccaagaaaatgcacgtcaaactcttcaatatccaagtcaaggaagtcacgacgcaagactcgacgacgaccatcaccaataaccttaccagcacgattcaggtgtttgcggacacggagtaccagctgccgtacgtagccagcaacgcccacgagggctgcctcccgccctttccggcggacgtcttcatgcttccgcagtatggctactgcacgctgcaacgcgagaactccaacgatcccgtggcccaaagctcgttctactgcctggagtacttccccagtcagatgctggggaccggaaacaactactccatcagctacacgttcgaagacgtacccttccacagcatgtacatgcacaatcagagcctggaccggctgatgaacccgctcatcgaccagtacctgtggttcctcaataataccgtagccaccaacaacaccaacaccttcaccaagtcgaccaaagacgatttgccacgccagaatcgcaattggctacccggacccgccttccagacggcggccttcaacttgaacggtcagaaccattttttcacgtccaatcactggggtttagttaacaagtacttgatgaatggaagaaacgtggcgattggccctggccctgtcgtagcccccaaaagcacgaccttccaggccgacggcatgatcttcgccaaaagcgcagctacggcgacatctgctgccgctcaagatacggtcaacatcaccagcgagtcggagacgtccaccgtcaaccccatgatgggcaccaaccctctcattatcaattcgagtaatactccatctacttccgcccccacgatgtcgaatcaagccgtcaatcccatcatgcctggctccgtttggcaagacagagacatctatcttcagggcccgatctgggccaagattccgcgcaccgatggaaccttccacccctcgcctctgatgggaggtttcgggctgcgtcatcctcctccacaaatcttcatcaagaacacacccgttccggccaaccctccaaccacgttcaatcccgccaaaatcaacgccttcatcacccaatactcgactggacaggtcaccgtcgagatggaatgggagctcgagaaggaaaacagcaagcgatggaacccggaaatccagttcaccaacaacttccaggtttcggacgggaacatggttcccttctgcgtggactcaaatggcgtctactccgaaccacgccccatcggaacccgctacctcacccgaaccctctaa

SEQ ID NO: 186 - DNA, 2209 bp, Caprine adeno-associated virus
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcacaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgcacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactattggggcttcagaccccggtctctcagagtcaaaatcttcaacatccaagtcaaagaggtcacggtgcaggactccaccaccaccatcgccaacaacctcacctccaccgtccaagtgtttacggacgacgactaccaactcccgtacgtcgtcggcaacgggaccgagggatgcctgccggccttccccccgcaggtctttacgctgccgcagtacggctacgcgacgctgaaccgagacaacggagacaacccgacagagcggagcagcttcttttgcctagagtactttcccagcaagatgctgaggacgggcaacaactttgagtttacctacagctttgaagaggtgcccttccactgcagcttcgccccgagccagaacctctttaagctggccaacccgctggtggaccagtacctgtaccgcttcgtgagcacctcggccacgggcgccatccagttccaaaagaacctggcgggcagatacgccaacacctacaaaaactggttcccggggcccatgggccgaacccagggctggaacacgagctctggcagcagcaccaacagagtcagcgtcaacaacttttccgtctcaaaccggatgaacctggagggggccagctaccaagtgaacccccagcccaacgggatgacaaacacgctccaaggcagcaaccgctacgcgctggaaaacaccatgatcttcaacgctcaaaacgccacgccgggaactacctcggtgtacccagaggacaatctactgctgaccagcgagagcgagactcagcccgtcaaccgggtggcttacaacacgggcggtcagatggccaccaacgcccagaacgccaccacggctcccacggtcgggacctacaacctccaggaagtgcttcctggcagcgtatggatggagagggacgtgtacctccaaggacccatctgggccaagatcccagagacgggggcgcactttcacccctctccggccatgggcggattcggactcaaacacccgccgcccatgatgctcatcaaaaacacgccggtgcccggcaacatcaccagcttctcggacgtgcccgtcagcagcttcatcacccagtacagcaccgggcaggtcaccgtggagatggaatgggagctcaaaaaggaaaactccaagaggtggaacccagagatccagtacaccaacaactacaacgacccccagtttgtggactttgctccagacggctccggcgaatacagaaccaccagagccatcggaacccgatacctcacccgacccctttaacccattcatgtcgcataccctcaataaa

SEQ ID NO: 187 - DNA, 447 bp, Bat adeno-associated virus
ctgcccacctacaacaaccacctctacaaacagatcaactcaaataccagcgacgccaaagaaacctactttggctacagcactccttgggggtattttgacttcaaccggttccactgtcacttctcgccgagggactggcaacgcctcatcaacaaccactggggcatgcgacccaaaagactcaactttaaactgtttaacatccaagtcaaagaggtcacgacgaacgacggtacgaagacgatcgcgaacaaccttacctcgacggtgcaagtctttgcggactcggagtaccaactcccctacgtgctaggaaacgctcacgagggctgctttccaccgtttccagcggacgtcttcatgctgccacaatacggatatctgactctcaattcgaacgacaacaaagccatgccacagagttccttctactgcctggaatac

SEQ ID NO: 188 - DNA, 462 bp, Bat adeno-associated virus
ctgcccgcctacaacaaccacctctaccgccagatccagtccagcggcaccggagacggcacgtactttggttacagcacgccttggggatacttcgatttcaatcgattccactgccacttttctcccagggactggcagcggctcatcaacaaccactggggcatccgccccaagcggctccactttaagctcttcaacatccaggtcaaggaggtcacgacgaccgacggcaccacgaccatcgccaacaacctcaccagcaccatacaggtctttgcggacacggagtaccagctcccgtacgtgctcggcaacgcccacgagggctgcctgccgccgttcccggcggacgtcttcatgctgccgcagtacgcgtacctgacgctcaacgccaacccgacgaaccagggcgcggccgcgctcagcctgccgcagagcgccttctactgcctagaatac

SEQ ID NO: 189 - DNA, 447 bp, Bat adeno-associated virus
ctgcccacctacaacaaccacctctacaaacagatcaactcaaataccagcgacgccaaagaaacctactttggctacagcactccttgggggtattttgacttcaaccggttccactgtcacttctcgccgagggactggcaacgcctcatcaacaaccactggggcatgcgacccaaaagactcaactttaaactgtttaacatccaagtcaaagaggtcacgacgaacgacggtacgaagacgatcgcgaacaaccttacctcgacggtgcaagtctttgcggactcggagtaccaactcccctacgtgctaggaaacgctcacgagggctgctttccaccgtttccagcggacgtcttcatgctgccacaatacggatacctgactctaaactcgaacgacaacaaagccatgccacagagttccttctactgcctggaatac

SEQ ID NO: 190 - DNA, 447 bp, Bat adeno-associated virus
ctgcccacctacaacaaccacctctacaaacagatcaactcaaataccagcgacgccaaagaaacctactttggctacagcactccttgggggtattttgacttcaaccggttccactgtcacttctcgccgagggactggcaacgcctcatcaacaaccactggggcatgcgacccaaaagactcaactttaaactgtttaacatccaagtcaaagaggtcacgacgaacgacggtacgaagacgatcgcgaacaaccttacctcgacggtgcaagtctttgcggactcggagtaccaactcccctacgtgctaggaaacgctcacgagggctgctttccaccgtttccagcggacgtcttcatgctgccacaatacggatacctgactctcaattcgaacgacaacaaagccatgccacagagttccttctactgcctggaatac

SEQ ID NO: 191 - DNA, 462 bp, Bat adeno-associated virus
ctgcccacctacaacaaccacctctaccgccagatccagtccagcggcaccggagacggcacgtactttggttacagcacgccttggggatacttcgatttcaatcgattccactgccacttttctcccagggactggcagcggctcatcaacaaccactggggcatccgccccaagcggctccactttaagctcttcaacatccaggtcaaggaggtcacgacgaccgacggcaccacgaccatcgccaacaacctcaccagcaccatacaggtctttgcggacacggagtaccagctcccgtacgtgctcggcaacgcccacgagggctgcctgccgccgttcccggcggacgtcttcatgctgccgcagtacgcgtacctgacgctcaacgccaacccgacgaaccagggcgcggccgcgctcagcctgccgcagagcgccttctactgcctagaatac

SEQ ID NO: 192 - DNA, 456 bp, Bat adeno-associated virus
ctgcccacctacaacaaccacctgtacaagcagatcaacggcaccggaaccggggacgcggtgtactttggttacagcacgccttggggatacttcgatttcaatcgattccactgccacttttctccccgagactggcagcgcctcgtcaacaaccactggggcatccgcccccgaaggctcatcttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtgttcatgctgccgcagtacggctacctcacgctcaacgggcccggcaccaacaacaacaacctcagcacgccctctagcgccttctactgcctagagtac

SEQ ID NO: 193 - DNA, 456 bp, Bat adeno-associated virus
ctgcccacctacaacaaccacctgtacaagcagatcaacggcaccggcaccggagacggcacgtactttggttacagcacgccttggggatacttcgatttcaatcgattccactgccacttttctccccgagactggcagcgcctcgtcaacaaccactggggcatccgcccccgaaggctcatcttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtgttcatgctgccgcagtacggctacctcacgctcaacgggcccggcaccaacaacaacaacctcagcacgccctcgagcgccttctactgcctagaatac

SEQ ID NO: 194 - DNA, 456 bp, Bat adeno-associated virus
ctgcccacctacaacaaccacctgtacaagcagatcaacggcaccggaaccggggacggggtgtactttggttacagcacgccttggggatacttcgatttcaatcgattccactgccacttttctccccgagactggcagcgcctcgtcaacaaccactggggcatccgcccccgaaggctcatcttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtcttcatgctgccgcagtacggctacctcacgctcaacgggcccggcaccaacaacaacaacctcagcacgccctcgagcgccttctactgcctagaatac

SEQ ID NO: 195 - DNA, 456 bp, Bat adeno-associated virus
ctgcccacctacaacaaccacctgtacaagcagatcaacggcaccggcaccggggacgcggtgtactttggttacagcacgccttggggatacttcgatttcaatcgattccactgccacttttctccccgagactggcagcgcctcgtcaacaaccactggggcatccgcccccgaaggctcagcttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtgttcatgctgccgcagtacggctacctcacgctcaacgggcccggcaccaacaacaacaacctcagcacgccctctagcgccttctactgcctagaatac

SEQ ID NO: 196 - DNA, 456 bp, Bat adeno-associated virus
ctgcccacctacaacaaccacctgtacaagcagatcaacggcaccggcaccggggacgcggtgtactttggttacagcacgccttggggatacttcgatttcaatcgattccactgccacttttctccccgagactggcagcgcctcgtcaacaaccactggggcatccgcccccgaaggctcagcttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtgttcatgctgccgcagtacggctacctcacgctcaacgggcccggcaccaacaacaacaacctcagcacgccctcgagcgccttctactgcctagaatac

SEQ ID NO: 197 - DNA, 444 bp, Bat adeno-associated virus
ctgcccagctacaacaaccaccgctacaagcaaatcaactcttcgtcagaaggagtcgacgaggcctactttggctacagcaccccgtggggatactttgactttaaccgcttccactgccacttttcaccccgagactggcagcgcctcatcaacaaccattggggcatccgtccaaagagcctcaactttaagctcttcaacatccaggtcaaggaggtcacaacgaacgacggaacgacaacgatcgccaataacctcacgtcaaccgtgcaggtgtttgcggacaccgagtaccagttgccctacatcctgggcaacgcgcacgagggctgcctcccaccgttcccagcggacgtgttcatgctgccgcagtacggatacctcacactgaacaagtctcacgatgcactggctcagggatccttctactgcctagaatac

SEQ ID NO: 198 - DNA, 444 bp, Bat adeno-associated virus
ctgcccacctacaacaaccacctctacaagcaaatcaattccaattcggatgtcaccgacgaaaagtactttggatacagtaccccgtggggatactttgactttaaccgcttccactgccacttttcaccccgagactggcagcgcctcatcaacaaccattggggtatgcgcccgaagaggctcaactttaagctgttcaacatccaggttaaggaggtcacgacgaacgacggcaccacgacaatcgccaacaatctcacgtctaccgtccagattttcgccgacagcgagtaccagttgccgtacgtgctcgggaatgcgcacgagggctgcctcccgccgttcccggcagatgtgttcatgctgccgcagtacgggtacctcacgttgaacgacggaaatcaagtgattccacaaagttccttctactgcctagaatac

SEQ ID NO: 199 - DNA, 444 bp, Bat adeno-associated virus
ctgcccacctacaacaaccacctctacaagcaaatcaactcaagttccgacgtcaccgacgaaaagtactttggctacagcaccccgtggggatactttgattttaaccgcttccactgccacttttcaccccgagactggcagcgcctcatcaacaaccactggggtatgcgcccaaagaggctcaactttaagctgttcaacatccaggtcaaggaggtcacgacgaacgacggcaccacgaccatcgccaacaacctcacgtctaccgtccagattttcgccgacagcgagtaccagctgccgtacgtgctcgggaatgcgcacgagggctgcctcccgccgttcccggcagatgtgtttatgctgccgcagtacgggtatctcacgctaaacgacggaaaccaagttattccgcagagttccttctactgcctagaatac

SEQ ID NO: 200 - DNA, 462 bp, Bat adeno-associated virus
ctgcccacctacaacaatcacctctacaagcagatgcagtcaacaggaaccggagacggcacctactacggttacagcacgccttggggatactttgatttcaatcgattccactgccacttttctccccgcgactggcagcgcctcatcaacaaccactggggcatccgcccaaagaaactcaactttaagctcttcaacatccaggtcaaggaggtcacaacgactgacggaacgacgacgatcgccaataacctcacaagcaccgtccaggtctttgcggaccaggagtaccagctcccgtacgtgctaggcaacgcccacgagggctgcctgccgccgtttccggctgacgtatttatgctgccgcagtacgggtacctcacgctcaactcgaaccccaccgcgcagggccagaacgccctctcgctgccgcagagcgccttctactgcctagaatac

SEQ ID NO: 201 - DNA, 462 bp, Bat adeno-associated virus
ctgcccacctacaacaatcacctctacaagcaaatgcagtcaacgggaaccggagacggcacctactacggttacagcacgccttggggatactttgatttcaatcgattccactgccacttttctccccgcgactggcagcgcctcatcaacaaccactggggcatccgcccaaagaaactcaactttaagctcttcaacatccaggtcaaggaggtcacaacgactgacggaacgacgacgatcgccaataacctcacaagcaccgtccaggtctttgcggaccaggagtaccagctcccgtacgtgctaggcaacgcccacgaaggctgcctgccgccgtttccggctgacgtgtttatgctgccgcagtacgggtacctcacgctcaactcgaacccgacatcgcagggccagaacgccctgtctctgccgcagagcgccttctactgcctagaatac

SEQ ID NO: 202 - DNA, 462 bp, Bat adeno-associated virus
ctgcccacctacaacaaccacctctacaagcagatgcagtcaacgggaaccggagacggcacctactacggttacagcacgccttggggatactttgatttcaatcgattccactgccacttttctccccgcgactggcagcgcctcatcaacaaccactggggcatccgcccaaagaaactcaactttaagctcttcaacatccaggtcaaggaggtcacaacgactgacggaacgacgacgatcgccaataacctcacaagcaccgtccaggtctttgcggaccaggagtaccagctcccgtacgtgctaggcaacgcccacgagggctgcctgccgccgtttccggctgacgtgtttatgctgccgcagtacgggtacctcacgctcaactcgaaccccaccgcgcagggccagaacgccctctcgctgccgcagagcgccttctactgcctagaatac

SEQ ID NO: 203 - DNA, 462 bp, Bat adeno-associated virus
ctgcccacctacaacaatcacctctacaagcaaatgcagtcaacgggaaccggagacggcacctactacggttacagcacgccttggggatactttgatttcaatcgattccactgccacttttctccccgcgactggcagcgcctcatcaacaaccactggggcatccgcccaaagaaactcaactttaagctcttcaacatccaggtcaaggaggtcacaacgactgacggaacgacgacgatcgccaataacctcacaagcaccgtccaggtctttgcggaccaggagtaccagctcccgtacgtgctaggcaacgcccacgagggctgcctgccgccgtttccggctgacgtgtttatgctgccgcagtacgggtacctcacgctcaactctaaccccaccgcgcagggccaaaacgccctctcgctgccgcagagcgccttctactgcctagaatac

SEQ ID NO: 204 - DNA, 453 bp, Bat adeno-associated virus
ctgcccacctataacaaccacgtctaccagcaaatcaactccaccaccggaggaaacggaacctactttggatacagcaccccctgggggtactttgacttcaaccgcttccactgccacttttctccccgagactggcagcgcctcatcaacaaccactggggcatgcgccccaagcggctcaactttaagctcttcaacatccaagtcaaggaggtcacgacgaacgacggcacgacgtccatcgccaataacctcacctccaccgtccaggtgtttgcggactcggagtaccagctcccgtacgtgctaggcaacgcccaggagggcaccttcccgcccttcccggccgacgtctttatgctcccgcagtacggctacctcacgctcaacgacaactcccagagcgcggccaaggccctgccgcagagcgccttctactgcctagaatac

SEQ ID NO: 205 - DNA, 453 bp, Bat adeno-associated virus
ctgcccacctacaacaaccacgtctaccagcaaatcaactccaccaccggaggaaacggaacctactttggatacagcaccccctgggggtactttgacttcaaccgcttccactgccacttttctccccgagactggcagcgcctcatcaacaaccactggggcatgcgccccaagcggctcaactttaagctcttcaacatccaagtcaaggaggtcacgacgaacgacggcacgacgtccatcgccaataacctcacctccaccgtccaggtctttgcggactcggagtaccagctcccgtacgtgctaggcaacgcccaggagggcaccttcccgcccttcccggccgacgtctttatgctcccgcagtacggctacctcacgctcaacgacaactcccagagcgcggccaaggccctgccgcagagcgccttctactgcctagaatac

SEQ ID NO: 206 - DNA, 456 bp, Bat adeno-associated virus
ctgcccacctacaacaaccacctgtacaagcagatcaacggcagcggaaccggggacgcggtgtactttggttacagcacgccttggggatacttcgatttcaatcgattccactgccacttttctccccgagactggcagcgcctcgtcaacaaccactggggcatccgcccccgaaggctcaacttcaagctcttcaacatccaagtcaaggaggtcacgacgacggacggcaccaagaccatcgccaataacctcacgtccaccgtccaggtgtttgcggacacggagcaccagctcccgtacatcctaggctccgctcacgagggctgcatgccgcccttccccgcggacgtcttcatgctgccgcagtacggctacctcacgctcaacgggcccggcagcaacaacaacaacctcagcacgccctcgagcgccttctactgcctagaatac

SEQ ID NO: 207 - DNA, 453 bp, Bat adeno-associated virus
ctgcccacctacaacaaccacgtctaccagcaaatcaactccaccaccggaggcaacggaacctactttggatacagcaccccctgggggtactttgactttaaccgattccactgccacttttcgccccgagactggcagcgactcatcaacaaccactggggcatgcgacccaagcgactcaactttaagctcttcaacatccaagttaaggaggtcacgacgaacgacggcacaacgtccatcgccaataacctcacgtccaccgtgcaggtctttgcggactcggagtaccagctcccgtacgtgctaggcaacgctcaggaaggaacgttccctcctttcccggccgacgtctttatgctgccgcagtacgggtaccttacgctcaacgacaacacacagaacggagccagagcgctgcctcagagcgccttctactgcctagaatac

SEQ ID NO: 208 - DNA, 456 bp, Bat adeno-associated virus
ctgcccacctacaacaaccacctgtacaagcagatcaacggcagcggcaccggagacggcacgtactttggttacagcacgccttggggatacttcgatttcaatagattccactgccacttttctccccgagactggcagcgcctcgtcaacaaccactggggcatccgcccccgaaggctcaacttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtcttcatgctgccgcagtacggctacctcacgctcaacgggcccggcaccaacaacaacaacctcagcacgccctccagcgccttctactgcctagaatac

SEQ ID NO: 209 - DNA, 444 bp, Bat adeno-associated virus
ctgcccacctacaacaaccagcagtacaagcgcatggactcaaagggagccaccagcaaggacaatttctacagctactctactccgtggggatactttgactttaaccgcttccagtaccacttttcaccccgagactggcagtgcttcgtcaacaacaattggggtatctggcccaagagacttctcttcaagctgttcaacgtccaggttaaggaggtcactacgcaggagggaaccacgaccatcaccaataacctcactagcaccatccaggtctttgcggactcggactaccagttcccgcacgtgctaggccatgcgcacgagggaacgctgccttccttcccggcccacgtcttcaccgtcccccagttcgcctactacacgttcaacaacggggacaacaccgcagctcgcagcaccttctactgcctagaatac

SEQ ID NO: 210 - DNA, 456 bp, Bat adeno-associated virus
ctgcccacctacaacaaccacctgtacaagcagatcaacggcaccggcaccggagacggcacgtactttggttacagcacgccttggggatacttcgatttcaatcgattccactgccacttttctccccgagactggcagcgcctcgtcaacaaccactggggcatccgcccccgaaggctcaacttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtgttcatgctgccgcagtacggctacctcacgctcaacgggcccggcaccaacaacaacaacctcagcacgccctcgagcgccttctactgcctagaatac

SEQ ID NO: 211 - DNA, 456 bp, Bat adeno-associated virus
ctgcccacctacaacaaccacctgtacaagcagatcaacggcaccggcaccggagacggcacgtactttggttacagcacgccttggggatacttcgatttcaatcgattccactgccacttttctccccgagactggcagcgcctcgtcaacaaccactggggcatccgcccccgaaggctcatcttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtgttcatgctgccgcagtacggctacctcacgctcaacgggcccggcaccaacaacaacaacctcagcacgccctcgagcgccttctactgcttagaatac

SEQ ID NO: 212 - DNA, 462 bp, Bat adeno-associated virus
ctgcccacctacaacaaccacatctaccgacagatacagtcctccggtaccggagacggcacctactttggttacagtacgccatggggatactttgatttcaatcgattccactgccacttttctccccgagactggcaacgactcatcaacaaccactggggcatccggcccaagcgactcaactttaagctgttcaacatccaggtcaaggaggtcacgacgaatgacggcacgacaacgatcgccaataacctcacgtccaccgtccaggtgtttgcggactcggactatcagctcccgtacgtgctaggaaacgcccacgagggctgtttcccgccatttcccgctgacgtgtttatgctgccacagtttggctacctgaccttgaatgcgacccctccgacccaaggacaagcggcactgagtatgcctcagagtgccttctactgcctagaatac

SEQ ID NO: 213 - DNA, 444 bp, Bat adeno-associated virus
ctgcccacctacaacaaccaccagtacaagcccatcgactcgaagggcgccaccagcaaggacaatttctacagctactccactccatggggatactttgactttaaccgcttccggtaccacttttcaccccgagactggcagtgcttcttcaacaccaattggggtatcaggcccaagagaccttccttcaagctgttcaacgtccaggttaaggaggtcactaggcaggagggagccacgaccatcaccaataacctcaccagcaccatccaggtctttgtggactcggactaccagttcccgcctgtgctaggcaccgcgcacgagggaatgctgcctcccttcccggccgacgtcttcactgtcccccagtacgcctactacacgctcaacaacggggacaacaccgcagctcgcagcaccttctactgcctagaatac

SEQ ID NO: 214 - DNA, 444 bp, Bat adeno-associated virus
ctgcccacctacaacaaccgccagtacaagcgcatcgactcaaacggagccaccagcaaggacagattctacagctactctactccatggggatactttgactttaatgacttccggtaccacttttcaccccgagactggcagtgcttcgtcaacaacaattggggtatctggcccaagggaccttccttcaagctgttcaacatccaggttaaggagctcactacgcaggagggagccacggccatcaccaatagcctcaccagcaccatccaggtctttgcggactcggactaccagttcccacacgtgctaggcaacgcgcacgagggaacgctgccccccttcccggccgacgtcttcaccgtcccccagtacgcctactacacgctcaaccacggggacagcgccacagctcgcagcaccttctactgcctagaatac

SEQ ID NO: 215 - DNA, 444 bp, Bat adeno-associated virus
ctgcccacctacaacaaccacctctacaagcaaatcaattccaactcggatgtcaccgacgaaaagtactttggatacagtaccccgtggggatactttgactttaaccgcttccactgccacttttcaccccgagactggcagcgcctcatcaacaaccattggggtatgcgcccgaagaggctcaactttaagctgttcaacatccaggttaaggaggtcacgacgaacgacggcaccacgacaatcgccaacaatctcacgtctaccgtccagattttcgccgacagcgagtaccagttgccgtacgtgctcgggaatgcgcacgagggctgcctcccgccgttcccggcagatgtgttcatgctgccgcagtacgggtacctcacgttgaacgacggaaatcaagtgattccacaaagttccttctactgcctagaatac

SEQ ID NO: 216 - DNA, 453 bp, Bat adeno-associated virus
ctgcccacctacaacaaccacgtctaccagcaaatcaactccaccaccggaggaaacggaacctactttggatacagcaccccctgggggtactttgacttcaaccgcttccactgccacttttctccccgagactggcagcgcctcatcaacaaccactggggcatgcgccccaagcggctcaactttaagctcttcaacatccaagtcaaggaggtcacgacgaacgacggcacgacgtccatcgccaataacctcacctccaccgtccaggtgtttgcggactcggagtaccagctcccgtacgtgctaggcaacgcccaggagggcaccttcccgcccttcccggccgacgtctttatgctcccgcagtacggctacctcacgctcaacgacaactcccagagcgcggccaaggccctgccgcagagcgccttctactgcctagaatac

SEQ ID NO: 217 - DNA, 444 bp, Bat adeno-associated virus
ctgcccacctacaacaaccacctctacaagcaaatcaactcaagctcagacgtcaacgacgaaaagtactttggatacagcaccccgtggggatattttgactttaaccgcttccactgccacttttcaccccgagactggcagcgcctcatcaacaaccactggggcatgcgcccgagaagactcaactttaagctttttaacatccaggttaaggaagtcaccacgaacgacggaaccacgaccatcgccaataacctcacgtcgaccgtccagattttcgccgacagcgagtaccagctgccgtacgtgctcgggaatgcgcacgagggctgcctcccgccgttcccggcagacgtgttcatgctgccgcagtacgggtacctcacgctgaacgacggaaaccaagtgattccgcagagctccttctactgcctagaatac

SEQ ID NO: 218 - DNA, 456 bp, Bat adeno-associated virus
ctgcccacctacaacaaccacctgtacaagcagatcaacggcagcggaaccggggacggcatgtactttggttacagcacgccttggggatacttcgatttcaatcgattccactgccacttttctccccgagactggcagcgcctcgtcaacaaccactggggcatccgcccccgaaggctcaacttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtcttcatgctgccgcagtacggctacctcacgctcaacgggcccggcaccaacaacaacaacctcagcacgccctcgagcgccttctactgcctagaatac

SEQ ID NO: 219 - DNA, 456 bp, Bat adeno-associated virus
ctgcccacctacaacaaccacctgtacaagcagatcaacggcagcggcaccggagacggcacgtactttggttacagcacgccttggggatacttcgatttcaatcgattccactgccacttttctccccgagactggcagcgcctcgtcaacaaccactggggcatccgcccccgaaggctcaacttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtcttcatgctgccgcagtacggctacctcacgctcaacgggcccggcaccaacaacaacaacctcagcacgccctcgagcgccttctactgcctagaatac

SEQ ID NO: 220 - DNA, 447 bp, Bat adeno-associated virus
ctgcccacctacaacaaccacctctacaaacagatcaactcaaataccagcgacgccaaagaaacctactttggctacagcactccttgggggtattttgacttcaaccggttccactgtcacttctcgccgagggactggcaacgcctcatcaacaaccactggggcatgcgacccaaaagactcaactttaaactgtttaacatccaagtcaaagaggtcacgacgaacgacggtacgaagacgatcgcgaacaaccttacctcgacggtgcaagtctttgcggactcggagtaccaactcccctacgtgctaggaaacgctcacgagggctgctttccaccgtttccagcggacgtcttcatgctgccacaatacggatatctgactctcaattcgaacgacaacaaagccatgccacagagttccttctactgcctagaatac

SEQ ID NO: 221 - DNA, 444 bp, Bat adeno-associated virus
ctgcccacctacaacaaccacctctacaaacaaatcaactccaccaaccagaccaacgacgagacctactttggatacaccacaccatggggatatttcgactttaaccgtttccactgccacttttcaccacgagattggcaacgactcatcaacaaccactggggcatgcgaccaaaaagactcaactttaaaatcttcaacatccaagtcaaagaggtcacgacgaatgatggaacgacgacaatcgccaataacctcacatccaccatccaggtgtttgcggacacggactatcagttaccgtacgtgctaggcaacgcacacgaaggctgtctaccaccatttccagccgatgtgtttatgctgccgcaatacggttatttgaccttgaatgaaggtcacaaggcaatgccgcagagctccttctactgcctagaatac

SEQ ID NO: 222 - DNA, 456 bp, Bat adeno-associated virus
ctgcccacctacaacaaccacctgtacaagcagatcaacggcaccggcaccggggacgcggtgtactttggttacagcacgccttggggatacttcgatttcaatcgattccactgccacttttctccccgagactggcagcgcctcgtcaacaaccactggggcatccgcccccgaaggctcagcttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtcttcatgctgccgcagtacggctacctcacgctcaacgggcccggcaccaacaacaacaacctcagcacgccctcgagcgccttctactgcctagaatac

SEQ ID NO: 223 - DNA, 462 bp, Bat adeno-associated virus
ctgcccacctacaacaaccacctctaccgccagatcaacggcaccggcaccggagacggcacgtactttggttacagcacgccttggggatacttcgatttcaatcgattccactgccacttttctcccagggactggcagcggctcatcaacaaccactggggcatccgccccaagcgcctccactttaagctcttcaacatccaggtcaaggaagtcacgacgaccgacggcaccacgaccatcgccaacaacctcaccagcaccatacaggtctttgcggacacggagtaccagctcccgtacgtgctcggcaacgcccacgagggctgcctgccgccgttcccggcggacgtcttcatgctgccgcagtacgcgtacctgacgctcaacgccaaccccacgaaccaaagcgccgccgcgctcagtctgccgcagagcgccttctactgcctagaatac

SEQ ID NO: 224 - DNA, 456 bp, Bat adeno-associated virus
ctgcccacctacaacaaccacctgtacaagcagatcaacggcaccggaaccggggacgcgggttactttggttacagcacgccttggggatacttcgatttcaatcgattccactgccacttttctccccgagactggcagcgcctcgtcaacaaccactggggcatccgcccccgaaggctcaacttcaagctcttcaacatccaggtcaaggaggtcacgacgacggacggcaccaagaccatcgccaataacctcacgtccaccgtccaggtgtttgcggacacggagcaccagctcccgtacatcctaggctccgcgcacgagggctgcatgccgcccttccccgcggacgtgttcatgctgccgcagtacggctacctcacgctcaacgggcccggcaccaacaacaacaacctcagcacgccctctagcgccttctactgcctagaatac

SEQ ID NO: 225 - DNA, 462 bp, Bat adeno-associated virus
ctgcccacctacaacaaccacctctaccgccagatccagtccagcggcaccggagacggcacgtactttggttacagcacgccttggggatacttcgatttcaatcgattccactgccacttttctcccagggactggcagcggctcatcaacaaccactggggcatccgccccaagcgcctccactttaagctcttcaacatccaggtcaaggaggtcacgacgaccgacggcaccacgaccatcgccaacaacctcaccagcaccatacaggtctttgcggacacggagtaccagctcccgtacgtgctcggcaacgcccacgagggctgcctgccgccgttcccggcggacgtcttcatgctgccgcagtacgcgtacctgacgctcaacgccaaccccacgaaccaaagcgccgccgcgctcagtctgccgcagagcgccttctactgcctagaatac

SEQ ID NO: 226 - DNA, 462 bp, Bat adeno-associated virus
ctgcccacctacaacaaccacctctacaaacaaatacagtcatcccagcaaggcgacggcacctactacggctacagcaccccgtggggatactttgactttaaccgcttccactgccacttttcaccccgagactggcagcgcctcatcaacaaccattggggcatccgtccgaagaggctcaactttaagctgttcaacatccaggccaaggaggtcacaacgaatgatggaacgacaacgatcgccaataacctcacatcgaccgtccaggtctttgcggacgcggagtaccagctaccgtacgtgctaggcaacgcccacgagggctgcctacctccgtttcccgcggatgtttttatgctgccgcagtacgggtacctcacgctcaactcgaaccccaccggctcccagacagctgccttcagtctgccgcagagcgccttctactgcctagaatac

SEQ ID NO: 227 - DNA, 444 bp, Bat adeno-associated virus
ctgcccacctacaacaaccaccgctacaaacaaatcaactcttcatcggaaggagtcgacgaggcctactttggctacagcaccccgtggggatactttgactttaaccgcttccactgccacttttcaccccgagactggcagcgcctcatcaacaaccattggggcatccgtccgaagagcctcaactttaagctcttcaacatccaggtcaaggaggtcacgacgaacgacggaacgacaacgatcgccaataacctcacgtcaaccgtgcaagtgtttgcggacaccgagtaccagctgccctacatcctgggcaacgcgcacgagggctgcctcccaccgttcccagcggacgtgttcatgctgccgcagtacggatacctaacgctgaacaagtctcacaatgctctggcccaggggtccttctactgcctcgaatac

SEQ ID NO: 228 - DNA, 444 bp, Bat adeno-associated virus
ctgcccacctacaacaaccaccagtacaagcgcatcgactcaaagggagccaccagcaaggacaatttctacagctactctactccgtggggatactttgactttaaccgcttccagtactacttttcaccccgaaactggcagtgcttcgtcaaatacaattggggtctctggtccaagagactttccttcaagctgttcaacgtccaggttaaggaggtcactacgcaggagggagccacgaccatcaccaataacctcaccagcaccatccaggtctttgcggactcggactaccagttcctgcacgtgctaggcaacgcgcacgagggaacgctgcctcccttcccggcccatgtcttcacggtcccccagtacgcctacgacacgctcaacaacggggacaacgccgcagctagcagcaccttctactgcctagaatac

SEQ ID NO: 229 - DNA, 440 bp, Bat adeno-associated virus
aacaaccaccgctacaagcagatcaactcttcatccgaaggagtcgacgaagcgtactttggatacagtaccccgtggggatactttgactttaaccgcttccactgccacttttcaccccgagactggcagcgcctcgtcaacaaccattggggtatccgcccaaagagcctcaactttaagctcttcaacatccaagtcaaggaggtcacgacgaacgacggaacaacgaccatcgccaataacctcacgtcgaccgtgcaagtgtttgccgacaccgagtaccagctgccctacgtcctgggcagtgcgcacgagggctgcctgccgccgttcccggccgacgtgttcatgctgccgcagtacggatacctcacgctgaacaagtcacacgatgctctggcacaggggtccttctactgcctggagtacaatctcaa

SEQ ID NO: 230 - DNA, 500 bp, Bat adeno-associated virus
actttggctctgagccagctcacccaagacggatccgagtcagcggcaggagccgcgggaggaagcgcacaggccccaaatatggccacttctgaaatggctgcagctggtggcggagcagtgggcgacgttggccaaggtgccgatggagtgggtagcgcctcgggagattggcattgcgattccacatggatgggagacagagtcatcaccaagtccaccagaacctgggccctcccaacctacaacaaccacctgtacaaaaagatcaacaactccaccaacagtaacacagacaaccaatacttcggctactccactccttggggatatttcgactttaaccgattccactgtcacttctcgccgagggattggcagcgccttgtcaacaacaactggggattccgaccgcgaagtctcaactttaagctgttcaacatccaagtcaaggaggtcacgcagactgatggaacgactacgattgccaataacctcac

SEQ ID NO: 231 - DNA, 2199 bp, Duck parvovirus
atgtctacttttttagagaaatttgaagactggtatgagactgcagccgcatcttggcggcatttgaaagctggagcccccaagccaaaatcaaaccagcaatctcagtctgtgtctacagacagaaaaccccaacgaacagacaataataggggctttgtacttcctgggtataagtatcttgggcctggtaacggccttgataaaggcccacctgtcaataaagcggacagcgtcgcgcttgagcacgataaagcgtacgaccaacagctcaaggcaggagacaacccctatataaaatttaatcacgcagatcaagaatttataaataatctgcaaggtgatacctcctttggaggcaacctcggaaaagccgtattccaagctaaaaaaagaattctagagcctttaggcctagtagaagaacctgtaaacacggctcctgctaaaaagagtagtggaaaactaacagatcactaccctatagtaaaaaagcctaaattatctgaagaaaactctccttcacccagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcattaccaagactacaagaacctgggtcctgccaagctacaacaaccacatctacaaagccatcacaagcggaacaaacccagacacaaatacccaatatgctggatacagcaccccctgggggtactttgatttcaacagattccactgccatttctctccaagagactggcagagactcatcaacaaccattgggggattagaccgaaagcactcaaattcaagatattcaatatgcaagttaaagaagtcacgacgcaagaccagacaaagactattgctaacaaccttacctctacaatccagatattcacggataatgaacaccagctgccctatgttctgggctcggccacggaggggacgatgccaccgttcccctcagatgtgtatgccttgccccagtacggctactgcacaatgcacaccaaccagagtggagctagattcaatgacagaagtgccttctattgcttagagtacttccccagtcaaatgctgagaacggggaataattttgaattcagttttgagtttgaagaagttcccttccatagcatgttcgctcattcacaggatttagataggctaatgaatcctctcctagatcagtacctgtggaatttctctgaggttaatggtggcaggaatgcacagttcaaaaaagctgtgaaaggagcatttggtgcaatggggagaaattggcttccaggacccaagcttctagaccaaagggtaagagtatacagtggaggaacagataactatgcaaactggtcaatctggactaaaggaaacaaagttttccttaaagacagagagtatctattgcaaccaggtccagtagctactacacatacagaagatcaggcttccagtataccggctcaaaacacaataggaattgcaaaagacccctacaggtcaggcagtactctggcaggaatttcagacattatggtaccagatgagcaagaaatagcaccaactaacggtgtagggtggagaccttatggattgaccgtaaccaatgaacaaaacacaacaacagctcctacaaatgctgagctagaagtactgggagcgctacctggcatggtctggcagaacagagatatttacctgcagggtcctatatgggctaaaatacccaaaacagatgggaaatttcatccttctccaacctggggaggttttggtctccataatccacctccccaggtctttattaagaatactcctgttcctgcagatcctccagtagagtatgtaaatcagaagtggaattcttacattacacagtattcaacagggcagtgtactgtagaaatggtctgggaactcagaaaagaaaactccaagagatggaaccctgagatccagtttaccagtaactttggaaatagaacaagtactatgtttgctccgaatgagactggaggctatgtagaagataggctgattggtaccaggtatttgactcagaatctgtaa

SEQ ID NO: 232 - DNA, 2199 bp, Duck parvovirus
atgtctacttttttagagaaatttgaagactggtatgagactgcagccgcatcttggcggcatttgaaagctggagcccccaagccaaaatcaaaccagcaatctcagtctgtgtctacagacagaaaaccccaacgaacagacaataataggggctttgtacttcctgggtataagtatcttgggcctggtaacggccttgataaaggcccacctgtcaataaagcggacagcgtcgcgcttgagcacgataaagcgtacgaccaacagctcaaggcaggagacaacccctatataaaatttaatcacgcagatcaagaatttataaataatctgcaaggtgatacctcctttggaggcaacctcggaaaagccgtattccaagctaaaaaaagaattctagagcctttaggcctagtagaagaacctgtaaacacggctcctgctaaaaagagtagtggaaaactaacagatcactaccctatagtaaaaaagcctaaattatctgaagaaaactctccttcacccagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcattaccaagactacaagaacctgggtcctgccaagctacaacaaccacatctacaaagccatcacaagcggaacaaacccagacacaaatacccaatatgctggatacagcaccccctgggggtactttgatttcaacagattccactgccatttctctccaagagactggcagagactcatcaacaaccattgggggattagaccgaaagcactcaaattcaagatattcaatgtgcaagttaaagaagtcacgacgcaagaccagacaaagactattgctaacaaccttacctctacaatccagatattcacggataatgaacaccagctgccctatgttctgggctcggccacggaggggacgatgccaccgttcccctcagatgtgtatgccttgccccagtacggctactgcacaatgcacaccaaccagagtggagctagattcaatgacagaagtgccttctattgcttagagtacttccccagtcaaatgctgagaacggggaataattttgaattcagttttgagtttgaagaagttcccttccatagcatgttcgctcattcacaggatttagataggctaatgaatcctctcctagatcagtacctgtggaatttctctgaggttaatggtggcaggaatgcacagttcaaaaaagctgtgaaaggagcatttggtgcaatggggagaaattggcttccaggacccaagcttctagaccaaagggtaagagtatacagtggaggaacagataactatgcaaactggtcaatctggactaaaggaaacaaagttttccttaaagacagagagtatctattgcaaccaggtccagtagctactacacatacagaagatcaggcttccagtataccggctcaaaacacaataggaattgcaaaagacccctacaggtcaggcagtactctggcaggaatttcagacattatggtaacagatgagcaagaaatagcaccaactaacggtgtagggtggagaccttatggattgaccgtaaccaatgaacaaaacacaacaacagctcctacaaatgctgagctacaagtactgggagcgctacctggcatggtctggcagaacagagatatttacctgcagggtcctatatgggctaaaatacccaaaacagatgggaaatttcatccttctccaaacctgggaggttttggtctccataatccacctccccaggtctttattaagaatactcctgttcctgcagatcctccagtagagtatgtaaatcagaagtggaattcttacattacacagtattcaacagggcagtgtactgtagaaatggtctgggaactcagaaaagaaaactccaagagatggaaccctgagatccagtttaccagtaactttggaaatagaacaagtactatgtttgctccgaatgagactggaggctatgtagaagataggctgattggtaccaggtatttgactcagaatctgtaa

SEQ ID NO: 233 - DNA, 2199 bp, Duck parvovirus
atgtctacttttttagagaaatttgaagactggtatgagactgcagccgcatcttggcggcatttgaaagctggagcccccaagccaaaatcaaaccagcaatctcagtctgtgtctacagacagaaaaccccaacgaacagacaataataggggctttgtacttcctgggtataagtatcttgggcctggtaacggccttgataaaggcccacctgtcaataaagcggacagcgtcgcgcttgagcacgataaagcgtacgaccaacagctcaaggcaggagacaacccctatataaaatttaatcacgcagatcaagaatttataaataatctgcaaggtgatacctcctttggaggcaacctcggaaaagccgtattccaagctaaaaaaagaattctagagcctttaggcctagtagaagaacctgtaaacacggctcctgctaaaaagagtagtggaaaactaacagatcactaccctatagtaaaaaagcctaaattatctgaagaaaactctccttcacccagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcattaccaagactacaagaacctgggtcctgccaagctacaacaaccacatctacaaagccatcacaagcggaacaaacccagacacaaatacccaatatgctggatacagcaccccctgggggtactttgatttcaacagattccactgccatttctctccaagagactggcagagactcatcaacaaccattgggggattagaccgaaagcactcaaattcaagatattcaatatgcaagttaaagaagtcacgacgcaagaccagacaaagactattgctaacaaccttacctctacaatccagatattcacggataatgaacaccagctgccctatgttctgggctcggccacggaggggacgatgccaccgttcccctcagatgtgtatgccttgccccagtacggctactgcacaatgcacaccaaccagagtggagctagattcaatgacagaagtgccttctattgcttagagtacttccccagtcaaatgctgagaacggggaataattttgaattcagttttgagtttgaagaagttcccttccatagcatgttcgctcattcacaggatttagataggctaatgaatcctctcctagatcagtacctgtggaatttctctgaggttaatggtggcaggaatgcacagttcaaaaaagctgtgaaaggagcatttggtgcaatggggagaaattggcttccaggacccaagcttctagaccaaagggtaagagtatacagtggaggaacagataactatgcaaactggtcaatcgggactaaaggaaacaaagttttccttaaagacagagagtatctattgcaacccggtccagtagctactacacatacagaagatcaggcttccagtataccggctcaaaacacaataggaattgcaaaagacccctacaggtcaggcagtactctggcaggaatttcagacattatggtaccagatgagcaagaaatagcaccaactaacggtgtagggtggagaccttatggattgaccgtaaccaatgaacaaaacacaacaacagctcctacaaatgctgagctacaagtactgggagcgctacctggcatggtctggcagaacagagatatttacctgcagggtcctatatgggctaaaatacccaaaacagatgggaaatttcatccttctccaaacctgggaggttttggtctccataatccacctccccaggtctttattaagaatactcctgttcctgcagatcctccagtagagtatgtaaatcagaagtggaattcttacattacacagtattcaacagggcagtgtactgtagaaatggtctgggaactcagaaaagaaaactccaagagatggaaccctgagatccagtttaccagtaactttggaaatagaacaagtactatgtttgctccgaatgagactggaggctatgtagaagataggctgattggtaccaggtatttgactcagaatctgtaa

SEQ ID NO: 234 - DNA, 1680 bp, Fox adeno-associated virus
gacgacgaagacctcgttgccaggcaacaggcagctcaatctggagcagaaggaaccggatcttcagctccagcagccaatcccgatttgggtcctactacaatgtctggaggcggaggcgcgccgatggcagacgatcaacagggtgccgatggagtgggtacttcctcaggaaattggcattgcgattccacctggctggacaaccgagtcattaccaaatccaccagaacctggagcctgcccacctacaacaaccacctctacaacaagatcgcctccaccaccacctccggaaacggaacctggttcggattcagtaccccctggggatactttgacttcaaccgcttccactgccacttctcgcctcgagactggcaacgactcatcaacaacaactggggtatccggcccaagaagatgcacgtcaagctcttcaatattcaagttaaagaagtcacgacgcaagactcgactacgaccatcaccaataaccttaccagcacgattcaagtgtttgcggacacggagtatcagctgccgtacgtagccggtaacgcccacgaaggatgccttccaccctttccggccgacgtcttcatgcttccgcagtacggctactgcactctgcaaaacgagaacaccaacgaacccgtgccacagagcgccttctactgcctggaatacttccccagccagatgctgaggaccggaaacaactacgccatcagctacagcttcgaagatgtgcccttccacagcatgtacatgcacaaccagagcctggaccggctgatgaacccgcttatcgaccagtacttgtggtacctgaccagcacgacgaacaatgccaacacgttcggcaagtcgaccaaagaagacctgcctcgtcagaaccggaactggctgcctgggcccgccttccaaacggcggcctataacctgaatggacagggaaactttgccagctccactcactggaactacctgaacaagtatagcctaaacggaagacaagcggccatcggtcctggtcccgtcgtagctcccaacgacgcaaccttccagtccaacggcatgatctttgccaagaacgccgatacacccgctacgtccgctcctcaagacaccgtcaacatcaccagcgagtcggagacttcaaccgtcaaccccaggatgggcatcaatcctctgatcattaataatagtaacaccccggctactaccgcgccctccatgtcgaatcgacctaccaatcccgtcatgcccggatccgtctggcaaaacagagacatttacctccagggcccgatctgggccaagatcccgcgtactgatggaaccttccacccttcgcctctgatgggaggcttcgggctgcgtcatcctcctcctcaaatcttcatcaagaacacgcccgttccggcgaatcctccgaccaccttcacacctgcgaaggtcaattccttcatcacccaatactcgaccggacaaatcaccgtggagatggaatgggagctggagaaggagaacagcaagagatggaacccggagatccagttcaccaacaattttaacacggcggacacgggcgtagtccccttctgcgtgaacaacgtcggagcctacttcgagtcccgtcccattggaacccgatacctcacccgtactctgtaa

SEQ ID NO: 235 - DNA, 2199 bp, Goose parvovirus
atgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacagaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagtttacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattacgcaaactggaacatctggagtaatggaaacaaggttaatttgaaggacaggcagtacctcctgcaacccggacctgtatcagctactcacacagaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagttcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 236 - DNA, 2199 bp, Goose parvovirus
atgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacaaagaccattgcaaacaatctcacgtcaacaattcaagtctttacggatgacgagcatcaactcccgtatgtcctgggctcggctacagaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagtttacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatccaggcggaacagataattacgcaaactggaacatctggagtaatggaaacaaggttaatttgaaggacaggcagtacctcctgcaacccggacctgtatcagctactcacacaaaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 237 - DNA, 2199 bp, Goose parvovirus
atgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtccttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggagaaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatggccagtatgcaggatacagtaccccctgggggtactttgatttcaaccgcttccactgccacttctcccctagagactggcagagacttatcaacaaccattggggaatcagacccaagtctcttaaattcaagatcttcaatgttcaagtcaaggaagtcacaacgcaggatcagacaaagaccattgcaaacaatctcacctcaacaattcaagtttttacggatgatgagcatcaactcccgtatgtcctgggctcggctacggaagggaccatgccgccgttcccgtcggatgtctatgccctgccgcagtacgggtactgcacaatgcacaccaaccagaatggagcacggttcaatgaccgtagtgcattctactgcttagagtacttccctagtcagatgctgagaacaggtaacaactttgagttcacatttgactttgaagaagttcctttccacagcatgttcgctcattcacaggacttagacaggcttatgaaccccctagtggatcaatacctctggaatttcaatgaggtagacagcagcagaaatgctcaatttaaaaaagctgtgaaaggggcttatggcaccatgggccgcaattggctgccaggacctaaattcctggatcagagagttagggcctacccaggaggaacagacaattatgcaaactggaacatctggagtaatgggaacaaggtgaatttaaaggacaggcagtatctcctacaacccggacctgtgtcagctactcacacagaaagggaggcttccagcatcccagctcagaatattttagggatagctaaagatccatacagatctggcagcactacagcaggaataagtgatattatggtcacggacgagcaggaagtagcacccacaaatgtagtagggtggaaaccatatggtaggactgtaacgaatgaacaaaacactactacagctcctacaagttcagatctggatgttcttggagctttaccaggaatggtgtggcagaacagagatatatatctgcagggacctatttgggcaaaaataccgaagactgatggcaaattccatccttctccaaatctcggaggatttggcctgcacaatccaccaccacaggtcttcatcaagaatacaccagtacctgcagaccctccagtagaatatgtgcaccagaagtggaactcctacataactcagtactctacgggccagtgtacagtagaaatggtgtgggagctgagaaaagagaattcaaagagatggaacccagaaatccagttcaccagcaatttcagtaacagaactaatatcatgtttgcacctaatgaaactggtggatatgtagaagatagattgattggaaccagatatctaactcaaaatctgtaa

SEQ ID NO: 238 - DNA, 2199 bp, Goose parvovirus
atgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtccttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggagaaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatggccagtatgcaggatacagtaccccctgggggtactttgatttcaaccgcttccactgccacttctcccctagagactggcagagacttatcaacaaccattggggaatcagacccaagtctcttaaattcaagatcttcaatgttcaagtcaaggaagtcacaacgcaggatcagacaaagaccattgcaaacaatctcacctcaacaattcaagtttttacggatgatgagcatcaactcccgtatgtcctgggctcggctacggaagggaccatgccgccgttcccgtcggatgtctatgccctgccgcagtacgggtactgcacaatgcacaccaaccagaatggagcacggttcaatgaccgtagtgcattctactgcttagagtacttccctagtcagatgctgagaacaggtaacaactttgagttcacatttgactttgaagaagttcctttccacagcatgttcgctcattcacaggacttagacaggcttatgaaccccctagtggatcaatacctctggaatttcaatgaggtagacagcagcagaaatgctcaatttaaaaaagctgtgaaaggggcttatggcaccatgggccgcaattggctgccaggacctaaattcctggatcagagagttagggcctacccaggaggaacagacaattatgcaaactggaacatctggagtaatgggaacaaggtgaatttaaaggacaggcagtatctcctacaacccggacctgtgtcagctactcacacagaaagggaggcttccagcatcccagctcagaatattttagggatagctaaagatccatacagatctggcagcactacagcaggaataagtgatattatggtcacggacgagcaggaagtagcacccacaaatgtagtagggtggaaaccatatggtaggactgtaacgaatgaacaaaacactactacagctcctacaagttcagatctggatgttcttggagctttaccaggaatggtgtggcagaacagagatatatatctgcagggacctatttgggcaaaaataccgaagactgatggcaaattccatccttctccaaatctcggaggatttggcctgcacaatccaccaccacaggtcttcatcaagaatacaccagtacctgcagaccctccagtagaatatgtgcaccagaagtggaactcctacataactcagtactctacgggccagtgtacagtagaaatggtgtgggagctgagaaaagagaattcaaagagatggaacccagaaatccagttcaccagcaatttcagtaacagaactagtataatgtttgcacctaatgaaactggtggatatgtagaagatagattaattggaaccagatatctaactcaaaatctgtaa

SEQ ID NO: 239 - DNA, 2199 bp, Goose parvovirus
atgtctacttttttagattcttttgaagagtggtatgaaactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggaacagacgaagaccattgcaaacaatctcacgtcaacaattcaagtctttacggatgacgagcatcaactcccgtatgtcctgggctcggctacagaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagtttacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatagaggcggaacagataattacgcaaactggaacatctggagtaatggaaacaaggttaatttgaaggacaggcagtacctcctgcaacccggacctgtatcagctactcacacagaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 240 - DNA, 2199 bp, Goose parvovirus
atgtctacttttttagattcttttgaagagtggtatgaaactgcagccgcctcgtggcggaatctgaaagctggagcccctcacccaaaaccaaaccagcagactcagtctgtgtctccagccagagaacccggacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggagaaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatggccagtatgcaggatacagtaccccctgggggtactttgatttcaaccgcttccactgccacttctcccctagagactggcagagacttatcaacaaccattggggaatcagacccaagtctcttaaattcaagatcttcaatgttcaagtcaaggaagtcacaacgcaggatcagacaaagaccattgcaaacaatctcacctcaacaattcaagtttttacggatgatgagcatcaactcccgtatgtcctgggctcggctacggaagggaccatgccgccgttcccgtcggatgtctatgccctgccgcagtacgggtactgcacaatgcacaccaaccagaatggagcacggttcaatgaccgtagtgcattctactgcttagagtacttccctagtcagatgctgagaacaggtaacaactttgagttcacatttgactttgaagaagttcctttccacagcatgttcgctcattcacaggacttagacaggcttatgaaccccctagtggatcaatacctctggaatttcaatgaggtagacagcagcagaaatgctcaatttaaaaaagctgtgaaaggggcttatggcaccatgggccgcaattggctgccaggacctaaattcctggatcagagagttagggcctacccaggaggaacagacaattatgcaaactggaacatctggagtaatgggaacaaggtgaatttaaaggacaggcagtatctcctacaacccggacctgtgtcagctactcacacagaaagggaggcttccagcatcccagctcagaatattttagggatagctaaagatccatacagatctggcagcactacagcaggaataagtgatattatggtcacggacgagcaggaagtagcacccacaaatgtagtagggtggaaaccatatggtaggactgtaacgaatgaacaaaacactactacagctcctacaagttcagatctggatgttcttggagctttaccaggaatggtgtggcagaacagagatatatatctgcagggacctatttgggcaaaaataccgaagactgatggcaaattccatccttctccaaatctcggaggatttggcctgcacaatccaccaccacaggtcttcatcaagaatacaccagtacctgcagaccctccagtagaatatgagcaccagaagtggaactcctacataactcagtactctatgggccagtgtacagtagaaatggtgtgggagctgagaaaagagaattcaaagagatggaacccagaaatccagttcaccagcaatttcagtaacagaactaatatcatgtttgcacctaatgaaactggtggatatgtagaagatagattgattggaaccagatatctaactcaaaatctgtaa

SEQ ID NO: 241 - DNA, 2199 bp, Goose parvovirus
atgtctacttttttagattcttttgaagagtggtacgaaactgcagccgcctcgtggcggaatctgaaagctggagcccctcacccaaaaccaaaccagcagactcagtctgtgtctccagccagagaacccgaacgaagagataataaccggggctttgtacttcctggctataagtatcttggccctggtaacggccttgataaagggccacccgttaataaggcggacagcgtcgcgcttgaacacgacaaggcctacgaccaacagcttaaagcgggagacaacccatatataagattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacaggaaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtcacttaaattcaagatcttcaatgtccaagtcaaagaagtcacaacgcaggatcagacaaagaccattgcaaacaatcttacgtcaacaattcaagtctttacggatgacgagcatcaactcccgtatgtcctgggctcggctacagaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagtttacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattacgcaaactggaacatctggagtaatggaaacaaggttaatttgaaggacaggcagtacctcctgcaacccggacctgtatcagctactcacacagaagcagaggcttccagcatcccagcccaaaatattttaggtttagctaaagatccatacagatctggcagcactacagcaggaataagtgatattatggtcacggacgagcaggaagtagcacctacgaacggcgtagggtggaaaccatatggcaaaactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcaatgacagaacaagcataatgtttgcacctaatgaaactggtggatatgtagaagatagattaattggaaccagatatctaactcaaaatctgtaa

SEQ ID NO: 242 - DNA, 2199 bp, Duck parvovirus
atgtctacttttttagagaaatttgaagactggtatgagactgcagccgcatcttggcggcatttgaaagctggagcccccaagccaaaatcaaaccagcaatctcagtctgtgtctacagacagaaaaccccaacgaacagacaataataggggctttgtacttcctgggtataagtatcttgggcctggtaacggccttgataaaggcccacctgtcaataaagcggacagcgtcgcgcttgagcacgataaagcgtacgaccaacagctcaaggcaggagacaacccctatataaaatttaatcacgcagatcaagaatttataaataatctgcaaggtgatacctcctttggaggcaacctcggaaaagccgtattccaagctaaaaaaagaattctagagcctttaggcctagtagaagaacctgtaaacacggctcctgctaaaaagagtagtggaaaactaacagatcactaccctatagtaaaaaagcctaaattatctgaagaaaactctccttcacccagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcattaccaagactacaagaacctgggtcctgccaagctacaacaaccacatctacaaagccatcacaagcggaacaaacccagacacaaatacccaatatgctggatacagcaccccctgggggtactttgatttcaacagattccactgccatttctctccaagagactggcagagactcatcaacaaccattgggggattagaccgaaagcactcaaattcaagatattcaatgtgcaagttaaagaagtcacgacgcaagaccagacaaagactattgctaacaaccttacctctacaatccagatattcacggataatgaacaccagctgccctatgttctgggctcggccacggaggggacgatgccaccgttcccctcagatgtgtatgccttgccccagtacggctactgcacaatgcacaccaaccagagtggagctagattcaatgacagaagtgccttctattgcttagagtacttccccagtcaaatgctgagaacggggaataattttgaattcagttttgagtttgaagaagttcccttccatagcatgttcgctcattcacaggatttagataggctaatgaatcctctcctagatcagtacctgtggaatttctctgaggttaatggtggcaggaatgcacagttcaaaaaagctgtgaaaggagcatttggtgcaatggggagaaattggcttccaggacccaagcttctagaccaaagggtaagagtatacagtggaggaacagataactatgcaaactggtcaatcgggactaaaggaaacaaagttttccttaaagacagagagtatctattgcaaccaggtccagtagctactacacatacagaagatcaggcttccagtataccggctcaaaacacaataggaattgcaaaagacccctacaggtcaggcagtactctggcaggaatttcagacattatggtaccagatgagcaagaaatagcaccaactaacggtgtagggtggagaccttatggattgaccgtaaccaatgaacaaaacacaacaacagctcctacaaatgctgagctacaagtactgggagcgctacctggcatggtctggcagaacagagatatttacctgcagggtcctatatgggctaaaatacccaaaacagatgggaaatttcatccttctccaaacctgggaggttttggtctccataatccacctccccaggtctttattaagaatactcctgttcctgcagatcctccagtagagtatgtaaatcagaagtggaattcttacattacacagtattcaacagggcagtgtactgtagaaatggtctgggaactcagaaaagaaaactccaagagatggaaccctgagatccagtttaccagtaactttggaaatagaacaagtactatgtttgctccgaatgagactggaggctatgtagaagataggctgattggtaccaggtatttgactcagaatctgtaa

SEQ ID NO: 243 - DNA, 2199 bp, Goose parvovirus
atgtctacttttttagattcattcgaagagtggtatgagactgcagccgcctcgtggcggaatctgaaagttggagcccctcacccaaaaccaaaccagcagactcagtctgtgtctccagccagagaacccgaacgaagagatagtaaccggggctttgtacttcctggctataagtatcttggccctggtaacggccttgataaagggccgcccgttaataaggcggacagcgtcgcgcttgaacacgacaaggcctacgaccaacagcttaaagcgggagacaacccttatataaaattcaatcacgctgaccaggactttatagatagcctccaagacgaccggtcgttcggaggtaacctcggaaaggccgtattccaggccaaaaaacgtatcctagagccattcggtctagtagaagactcgatcaacacggcacccgtcaaaaaaaatacagggaaacttactgaccattacccggtggttaagaagcctaaacttaccgaggaggtcagtgcaggaggtggtaccagtgcagtacaagacggaggagccaccgcggagggtaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggtagaatacgtacaccagaagtggaattcttacataacccagtattcttcgggccagtgtacagtagagatggtgtgggagctcagaaaagagaattcaaagcggtggaatccagaaattcagttcaccagcaatttcagtgacagaacaagcataatgtttgcacctaatgaaactggtggatacatagaagatagattgattggaaccagatatctaactcaaaatctgtaa

SEQ ID NO: 244 - DNA, 2199 bp, Goose parvovirus
atgtctacttttttagattcattcgaagagtggtatgagactgcagccgcctcgtggcggaatctgaaagctggagcccctcacccaaaaccaaaccagcagactcagtctgtgtctccagccagagaacccgaacgaagagatagtaaccggggctttgtacttcctggctataagtatcttggccctggtaacggccttgataaagggccgcccgttaataaggcggacagcgtcgcgcttgaacacgacaaggcctacgaccaacagcttaaagcgggagacaacccatatataaaattcaatcacgctgaccaggactttatagatagcctccaagacgaccggtcgttcggaggtaacctcggaaaggccgtattccaggccaaaaaacgtatcctagagccattcggtctagtagaagactcgatcaacacggcacccgtcaaaaaaaatacagggaaacttactgaccattacccggtggttaagaagcctaaacttaccgaggaggtcagtgcaggaggtggtaccagtgcagtacaagacggaggagccaccgcggagggtaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgctgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcgatttaaaaacgctgtgaaaggcgcttatggcaccatgggccgcaattggctgccaggacctaaattcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggtagaatacgtacaccagaagtggaattcttacataacccagtattcttcgggccagtgtacagtagagatggtgtgggagctcagaaaagagaattcaaagcggtggaatccagaaattcagttcaccagcaatttcagtgacagaacaagcataatgtttgcacctaatgaaactggtggatacgtagaagatagattgattggaaccagatatctaactcaaaatctgtaa

SEQ ID NO: 245 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggtagaatacgtacaccagaagtggaattcttacataacccagtattcttcgggccagtgtacagtagagatggtgtgggagctcagaaaagagaattcaaagcggtggaatccagaaattcagttcaccagcaatttcagtgacagaacaagcataatgtttgcacctaatgaaactggtggatacatagaagatagattgattggaaccagatatctaactcaaaatctgtaa

SEQ ID NO: 246 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcagcaactttgagttcacgtttgactttgaagaagttcctttccacagcatgttcgctcattcacaggacttagacaggctgatgaaccccttagtggatcaatacctctggaatttcaatgaggtagacagcagcagaaaagctcaatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacagtactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggtagaatacgtacaccagaagtggaattcttacataacccagtattcttcgggccagtgtacagtagagatggtgtgggagctcagaaaagagaattcaaagcggtggaatccagaaattcagttcaccagcaatttcagtgacagaacaagcataatgtttgcacctaatgaaactggtggatacatagaagatagattgattggaaccagatatctaactcaaaatctgtaa

SEQ ID NO: 247 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctcccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcacaatgcacaccaaccagaatggagcacgattcaatgaccggagtgcattctactgcttagaatacttccccagtcagatgctaagaacaggcaacaactttgagtttacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacccggacctgtatcagctactcacacagaagcagaggcttccagccttccagctcaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggttttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 248 - DNA, 1605 bp, Goose parvovirus
atggcagagggaggaggcggagctttgggcgactcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacaaagaccattgcaaacaatctcacctcgacaattcaagtctttacggatgacgagcatcaactcccgtatgtcctgggctcggctacggaaggcaccatgccgccgttcccgtcggatgtctatgccctgccgcagtacgggtactgcacaatgcacaccaaccagaatggagcacgattcaatgaccggagtgcattctactgcttagaatacttccccagtcagatgctaagaacaggcaacaactttgagtttacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacccggacctgtatcagctactcacacagaagcagaggcttccagccttccagctcaaaatatgttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 249 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgcccagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtgcaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcacaatgcacaccaaccagaatggagcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggaccaaaattcctggaccagagagttagggcctatacaggcggaacagataattatgcaaactggaacatctggagtaatggaaacaaggttaatttgaaggacaggcagtacctcctgcaacccggacctgtatcagctactcacacagaagcagaggcttccagccttccagctcaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggttttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 250 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccctatgtcctgggctcggctacggaaggcaccatgccgccgttcccgtcggatgtctatgccctgccgcagtacgggtattgcacaatgcacaccaaccagaatggagcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaactgataattatgcaaactggaacatctggagtaatggaaacaaggttaatttgaaggacaggcagtacctcctgcaacccggacctgtatcagctactcacacagaagcagaggcttccagccttccagctcaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggttttggtctgcacaatccaccaccgcaggtgttcatcaaggatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 251 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccctatgtcctgggctcggctacggaaggcaccatgccgccgttcccgtcggatgtctatgccctgccgcagtacgggtattgcacaatgcacaccaaccagaatggagcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacccggacctgtatcagctactcacacagaagcagaggcttccagccttccagctcaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctacagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 252 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctcccaagctacaacaaccacatctacaaagcgattaccagtggaacctctcaagatgcaaatgtccagtatgtaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcggtacgggtattgcacaatgcacaccaaccagaatggagcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacccggacctgtatcagctactcacacagaagcagaggcttccagccttccagctcaaaatatgttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 253 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtgtatgccctgccgcrgtacrggtattgcacaatgcacaccaaccagaatggagcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaactgataattatgcaaactggaacatctggagtaatggaaacaaggttaatttgaaggacaggcagtacctcctgcaacccggacctgtatcagctactcacacagaagcagaggcttccagccttccagctcaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggttttggtctgcacaatccaccaccgcaggtgttcatcaaggatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 254 - DNA, 1646 bp, Goose parvovirus
tgaaatggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcgatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggcagaatacgtacaccagaagtggaattcttacataacccagtattctacgggccagtgtacaatagagatggtgtgggagctcagaaaagagaattcaaagcggtggaatccagaaattcagttcaccagcaatttcagtgacagaacaagcataatgtttgcacctaatgaaactggtggatacatagaagatagattgattggaaccagatatctaactcaaaatctgtaatgtctgtaaaaagattcaaataaagcacttcctggcg

SEQ ID NO: 255 - DNA, 1764 bp, Goose parvovirus
acggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccttggggatactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaacccatagtggatcaatacctctggaatttcaatgaggtagacagcagcagaaatgctcaatttaaaaaggctgtgaaaggcgcttatggaaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacccggacctgtatcagctactcatacagaagcagaggcttccagtatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 256 - DNA, 2199 bp, Goose parvovirus
atgtctacttttttagattcattcgaagagtggtatgagactgcagccgcctcgtggcggaatctgaaagctggagcccctcacccaaaaccaaaccagcagactcagtctgtgtctccagccagagaacccgaacgaagagatagtaaccggggctttgtacttcctggctataagtatcttggccctggtaacggccttgataaagggccgcccgttaataaggcggacagcgtcgcgcttgaacacgacaaggcctacgaccaacagcttaaagcgggagacaacccatatataaaattcaatcacgctgaccaggactttatagatagcctccaagacgaccggtcgttcggaggtaacctcggaaaggccgtattccaggccaaaaaacgtatcctagagccattcggtctagtagaagactcgatcaacacggcacccgtcaaaaaaaatacagggaaacttactgaccattacccggtggttaagaagcctaaacttaccgaggaggtcagtgcaggaggtggtaccagtgcagtacaagacggaggagccaccgcggagggtaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcacgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaagctgtgaaaggcgcttatggcaccatgggccgcaattggctgccaggacctaaattcctggaccagagagttagggcctatacaggcggaacaaataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggtagaatacgtacaccagaagtggaattcttacataacccagtattcttcgggccagtgtacagtagagatggtgtgggagctcagaaaagagaattcaaagcggtggaatccagaaattcagttcaccagcaatttcagtgacagaacaagcataatgtttgcacctaatgaaactggtggatacgtagaagatagattgattggaaccagatatctaactcaaaatctgtaa

SEQ ID NO: 257 - DNA, 2199 bp, Goose parvovirus
atgtctacttttttagattcttttgaagagtggtatgagactgcagccgcctcgtggcggaatctgaaagctggagcccctcagccaaaaccaaaccagcagtctcagtctgtgtctccagacagagaacccgaacgaagagataataatcggggctttgtacttcctggctataagtatcttgggcctggtaacggccttgataaaggcccacctgtcaataacgcggacagcgtcgcgcttgaacacgacaaggcctacgaccagcagcttaaagcgggagacaatccatatataaaattcaatcacgctgaccaggactttatagatagtctccaagacgaccagtcattcggaggtaatcttggaaaggctgtatttcaggccaaaaaacgtatcttagagccatttggcctagtagaagatcctatcaacacggcacctgcaaaaaaaaatacagggaagcttactgaccattacccggtagttaagaagcctaaacttaccgaggaagtcagtgcgggaggtggtagcagtgccgtagaagacggaggagccaccgcggagggcaccgaacctgtggcagcatctgaaatggcagagggaggaggcggagctatgggcgactcttcagggggtgccgatggagtgggtaatgcctcgggaaattggcattgcgattcccaatggatgggaaacacagtcatcacaaagaccaccagaacctgggtcctgccaagctacaacaaccacatctacaaagcaattaccagtggaacctctcaagatgcaaatgtccagtatgcaggatacagtaccccctgggggtactttgatttcaaccgcttccactgccacttctcccctagagactggcagagacttatcaacaaccattggggaatccgacccaaatctcttaaattcaagatcttcaatgtccaagtcaaagaagtcacaacgcaggatcaaacaaagaccattgcaaacaatctcacctcaacgattcaagtctttacggatgatgagcatcaactcccgtatgtcctgggctcggctacggaaggcaccatgccgccgttcccgtcggatgtctatgccctgccgcagtacgggtactgcacaatgcacaccaaccagaatggagcacggttcaatgaccgtagtgcattctactgcttagagtacttccctagtcagatgctaagaacaggcaacaactttgagttcacatttgactttgaagaagttcctttccatagcatgttcgctcattcacaggacctagacaggctgatgaaccccctagtggatcaatacctctggaatttcaatgaggtagacagcagcagaaatgctcaatttaaaaaggctgtgaaaggggcgtatagcaccatgggccgcaattggctgccaggacctaaattcctggatcaaagagttagggcctacgcaggaggaacagacaactatgcaaactggaacatctggagtaatgggaacaaggtgaatttaaaagacaggcagtatctcctacaacccggacctgtgtcagcgactcacacagaaggggaggcttccagcattccagctcaaaatattttagggatagctaaagatccatacagatctggcagcactacagcaggaataagtgacattatggtcacggaagaacaagaagtagcacctacaaatggagtagggtggaaaccatatggtaggactgtaacggataaacagaacactactacagctcctaaaagctcagatctggaagttcttggagctttaccaggaatggtttggcagaacagggatatatatctgcagggacctatttgggcaaaaataccgaagactgatggcaaattccatccttctccgaatctcggaggatttggcctgcacaatccaccaccgcaggtgttcatcaagaatacaccagtgcctgcagaccctccagtagaatacgtgcaccagaagtggaattcctacataactcagtactctacgggccagtgtacagtagagatggtgtgggagctgagaaaagagaattcaaagagatggaacccagaaatccagttcaccagtaatttcagtaacagaacaagcataatgtttgcacctaatgaaactggtggatatgtagaagatagattgattggaaccagatatctaactcaaaatctgtaa

SEQ ID NO: 258 - DNA, 2199 bp, Goose parvovirus
atgtctacttttttagattcttttgaagagtggtatgagactgcagccgcctcgtggcggaatctgaaagctggagcccctcacccaaaaccaaaccagcagactcagtctgtgtctccagccagagaacccgaacgaagagataataaccggggctttgtacttcctggctataggtatcttggccctggtaacggccttgataaagggccacccgttaataaggcggacagcgtcgcgcttgaacacgacaaggcctacgaccaacagcttaaagcgggcgacaacccatatataaaattcaatcacgctgaccaggactttatagatagcctccaagacgaccagtcgttcggaggtaatcttggaaaggctgtatttcaggccaaaaaacgtatcttagaaccatttggcctagtagaagatcctgtcaacacggcacctgcaaaaaaaaatacagggaagcttaccgaccactacccggtagttaagaagcctaaacttaccgaggaagtcagtgcgggaggtggtagtagtgccgtacaagacggaggagccaccgcggagggcaccgaacctgtggcagcatctgaaatggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgcccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtactgcaccatgcacaccaaccagaatggagcacggttcaatgaccgtagtgcattctactgcttagagtacttccctagtcagatgctaagaacaggcaacaactttgagttcacatttgactttgaagaagttcctttccatagcatgttcgctcattcacaggacttagacaggctgatgaaccccctagtggatcaatacctctggaatttcaatgaggtagacagcaggagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacctggacctgtatcagctactcacacaaaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaagagtgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatacatagaagatagattgattggaaccagatatctaactcaaaatctgtaa

SEQ ID NO: 259 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaaaactacccgaacttgggtcttgccgagctacaataaccacatctacaaagcaattaccagcggaacctctcaggacgcaactgtccagtatgctggatacagtactccctgggggtacttcgatttcaaccgcttccactgccacttctccccgagagactggcaaagacttatcaacaaccattggggaatcagacccaagtcccttaaatttaagatcttcaatgtccaagtcaaagaagtcacaacgcaggatcagacgaagaccattgcaaacaatctcacgtcaacgattcaagtgttcacggatgatgagcatcaactcccgtatgtgctgggctcggctacggaaggcaccatgccgccgttcccgtcggatgtgtatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacaaatggcgtagggtggaaaccatatggcaagactgtaacgaatgaacaaaacactactacagctcctacgagttcagatcttgatgttcttggagctttaccaggaatggtctggcagaacagagatatatatctacagggacctatttgggctaaaataccaaagaccgatggcaaattccatccttctccgaatctcggaggatttggcctgtacaacccaccaccacaggtcttcatcaagaatacaccggtacctgcagaccctccggtagaatacgtacaccagaagtgtaattcttacataacccagtattcttcgggccagtgtacagtagagatggtgtgggagctcagaaaagagaattcaaagcggtggaatccagaaattcagttcaccagcaatttcagtgacagaacaagcataatgtttgcacctaatgaaactggtggatacatagaagatagattgattggaaccagatatctaactcaaaatctgtaa

SEQ ID NO: 260 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcgatttaaaaaagctgtgaaaggcgcttatggcaccatgggccgcaattggctgccaggacctaaactcctggaccagagagttagggcctatacaggcggaacagataattatgcaaactggaacatctggagtaatggaaacaaggtcaatttgaaggacaggcagtacctcttgcaacccggacctgtatcagctactcacacaaaagtagaggcttccagcatcccagcccaaaatattttaggtttagctaaagatccatacagatctggcagcactacagcaggaataagtgatattatggtcacggacgagcaggaagtagcacctacraayggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 261 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacaaagaccattgcaaacaatctcacgtcaacaattcaagtctttacggatgacgagcatcaactcccgtatgtcctggggtcggctacggaaggcaccatgccgccgttcccgtcggatgtctatgccctgccgcagtacgggtactgcaccatgcacaccaaccagaatggagcacggttcaatgaccgtagtgcattctactgcttagagtacttccctagtcagatgctaagaacaggcaacaactttgagttcacatttgactttgaagaagttcctttccatagcatgttcgctcattcacaggacttagacaggctgatgaaccccctagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacctggacctgtatcagctactcacacagaagcagaggcttccagcatcccagcccaaaatattttaggtttagctaaagatccatacagatctggcagcactacagcaggaataagtgatgttatggtcacggacgagcaggaagtagcacctacaaacggcgtagggtggaaaccatatggcaagactgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatacatagaagatagattgattggaaccagatatctaactcaaaatctgtaa

SEQ ID NO: 262 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgcccagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtgcaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaactgataattatgcaaactggaacatctggagtaatggaaacaaggttaatttgaaggacaggcagtacctcctgcaacccggacctgtatcagctactcacacagaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctacagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcatctaatgaaactggtggatatgtagaagatagattatttggaaccagatatctaactcaaaatctgtaa

SEQ ID NO: 263 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacagtctcacgtcaacaattcaagtctttacggacgacgagcatcaactcccgtatgtcctgggctcggctacggaaggcaccatgccgccgttcccgtcggatgtctatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacccggacctgtatcagctactcacacagaagcagaggcttcctgcatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 264 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacgaaaggcaccatgccgccgttcccgtcggatgtctatgccctgccgcagtacgggtattgcacaatgcacaccaaccagaacggtgcacgattcaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaacagataattatgcaaactggaacatctggagtaatggaaacaaggtcaatttgaaggacaggcagtacctcctgcaacccggacctgtatcagctactcacacagaagcagaggcttccagcatcccagcccaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctgcagggacctatttgggcaaaaataccgaagactgatggtaaattccatccttctccgaatctcggaggttttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggggctgagaaaagagaattcaaggagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 265 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgccaagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtccaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtactgcaccatgcacaccaaccagaatggagcacggttcaatgaccgtagtgcattctactgcttagagtacttccctagtcagatgctaagaacaggcaacaactttgagttcacatttgactttgaagaagttcctttccatagcatgttcgctcattcacaggacttagacaggctgatgaaccccctagtggatcaatacctctggaatttcaatgaggtagacagcagcagaaatgctcaatttaaaaaggctgtgaaaggggcttatggcaccatgggccgcaattggctgccaggacctaaattcctggaccagagagttagggcctatacaggcggaacagataattatgcaaactggaacatctggagtaatggaaacaaggttaatttgaaggacaggcagtacctcctgcaacctggacctgtatcagctactcacacagaagcagaggcttccagcatcccagcccaaaatattttaggtttagctaaagatccatacagatctggcagcactacagcaggaataagtgatgttatggtcacggacgagcagggagtagcacctacaaacggcgtagggtggaaaccatatggcaagactgtaacgaatgaacaaaacactactacagctcctacgagttcagatcttgatgttcttggagctttaccaggaatggtttggcagaacagagatatatatctacagggacctatttgggctaaaataccaaagaccgatggcaaattccatccttctccgaatctcggaggatttggcctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatacatagaagatagattgattggaaccagatatctaactcaaaatctgtaa

SEQ ID NO: 266 - DNA, 1605 bp, Goose parvovirus
atggcagagggaggaggcggagctttgggcgacgcttcagggggtgccgatggagtgggtaatgcctcgggaaattggcattgcgattcccaatggatgggaaacacagtcatcacaaagaccaccagaacctgggtcctgcccagctacaacaaccacatctacaaagcgattaccagtggaacctctcaagatgcaaatgtccagtatgcaggatacagtaccccctgggggtactttgatttcaaccgcttccactgccacttctcccctagagactggcagagacttatcaacaaccattggggaatcagacccaagtctcttaaattcaagatcttcaatgtgcaagtcaaagaagtcacaacgcaggatcagacgaagaccattgcaaacaatctcacgtcaacaattcaagtctttacggatgacgagcatcaactcccgtatgtcctgggctcggctacggaaggcaccatgccgccgttcccgtcggatgtctatgccctgccgcagtacgggtattgcacaatgcacaccaaccagaatggacacgattcaaatgaccggagtgcattctactgcttagaatacttccccagtcagatgctaagaacaggcaacaactttgagttcacgtttgactttgaagaagttcctttccacagcatgttcgctcattcacaggacttagacaggctgatgaaccccttagtggatcaatacctctggaatttcaatgaggtagacagcagcagaaatgctcaatttaaaaaggctgtgaaaggcgcttatggcaccatgggccgcaattggctgccaggacctaaattcctggaccagagagttagggcctatacaggcggaactgataattatgcaaactggaacatctggagtaatggaaacaaggttaatttgaaggacaggcagtacctcctgcaacccggacctgtatcagctactcacacagaagcagaggcttccagccttccagctcaaaatattttaggtttagctaaagatccatacagatctggcagcactacagcaggaataagtgatattatggtcacggacgagcaggaagtagcacctacaaacggcgtagggtggaaaccatatggcaagactgtaacgaatgaacaaaacactactacagctcctacaagttcagatctggatgttcttggagctttaccaggaatggtttggcagaacagggatatatatctacagggacctatttgggcaaaaataccgaagactgatggtaaattccatccttctccgaatctcggaggatttggtctgcacaatccaccaccgcaggtgttcatcaagaatacaccagtgcctgcagaccctccagtagaatacgtgcaccagaagtggaattcctacataacccagtactctacgggccagtgtacagtagagatggtgtgggagctgagaaaagagaattcaaagagatggaacccagaaatccagttcaccagtaatttcagtgacagaacaagcataatgtttgcacctaatgaaactggtggatatgtagaagatagattaattggaaccagatatctaactcaaaatctgtaa

SEQ ID NO: 267 - DNA, 2199 bp, Goose parvovirus
atgtctacttttttagagaaatttgaagactggtatgagactgcagccgcatcttggcggcatttgaaagctggagcccccaagccaaaatcaaaccagcaatctcagtctgtgtctacagacagaaaaccccaacgaaaagacaataataggggctttgtacttcctggctataagtatcttgggcctggtaacggccttgataaaggcccacctgtcaataaagcggacaacatcgcgcttgagcacgataaagcgtacgaccagcagctcaaggcaggagacaacccctatatcaaatttaatcacgcagatcaagaatttatagataatctgcaaggtgatacctcctttggaggcaacctcggaaaagccgtattccaagctaaaaaaagaattctagagcctttaggcctagtagaagaacctgtaaacacggctcctgctaaaaagagtagtggaaagctaacagatcactaccctatagtaaaaaagcctaaattatctgaagaaaactctccttcacccagtaatagtggaggagaagcaagtgcagctgccaccgaaggctccgaacctgtggcagcacctaacatggcagagggaggaagcggagctatgggcgactctgcagggggtgccgatggagtgggtaatgcctcaggaaattggcattgcgattcccaatggctgggagacacagtcattaccaagactacaagaacctgggtcctgccaagctacaacaaccacatctacaaagccatcacaagcggaacaaacccagactcaaatacccaatatgctggatacagcaccccctgggggtactttgatttcaacagattccactgccatttctctccaagagactggcagagactcatcaacaaccattgggggattagaccgaaagcactcaaattcaagatattcaatgtgcaagttaaagaagtcacgacgcaagaccagacaaaaactattgctaacaaccttacctctacaatccagatattcacggataatgaacaccagctgccctatgttctgggctcggccacggaggggacgatgccaccgttcccctcagatgtgtatgccttgccccagtacggctactgcacaatgcacaccaaccagagtggagctagattcaatgacagaagtgccttctattgcttagagtacttccccagtcagatgctgagaacagggaataattttgaattcagttttgagtttgaagaagttcccttccatagcatgttcgctcattcacaggatttagacaggctaatgaatcctctcctagatcagtacctgtggaatttctctgaggttaatggtggcaggaatgcacagttcaaaaaagctgtgaaaggagcatttggtgcaatggggagaaattggcttccaggacccaaacttctagaccaaagggtaagagcatacagtggaggaacagataactatgcgaactggtcaatctggagtaaaggaaacaaagtttttcttaaagacagagagtatctactgcaaccaggtccagtagctactacacatacaaaagatcaggcttccagtataccggctcaaaacacaataggaattgcaaaagacccctacaggtcaggcagtagtctggcaggaatttcagacattatggtaacagaagagcaagaaatagcaccaactaatggtgtagggtggagaccttatggattgaccgtaaccaatgaacaaaacacaacaacagctcctacaaatgctgacctagaagtactgggagcgctacctggcatggtctggcagaacagagatatttacctgcagggtcctatatgggctaaaatacccaaaacagatgggaaatttcatccttctccaaacctgggaggttttggtctccataatccacctccccaggtctttataaaaaatactcctgttcctgcagatcctccagtagagtatgtaaatcagaagtggaattcttacattacacagtattcaacagggcagtgtactgtagaaatggtctgggaactcagaaaagaaaactccaagagatggaaccctgagatccagtttaccagtaactttggaaatagaacaagtactatgtttgctccgaatgagactggaggctatgtagaagataggctgattggtaccaggtatttgactcagaatctgtaa

SEQ ID NO: 268 - DNA, 2211 bp, Muscovy duck parvovirus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 269 - DNA, 2190 bp, Non-human primate Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgcctgcaagaagatacgtcatttgggggcaacctcgggcgagcagtcttccaggccaagaagcgggttctcgaacctctcggtctggttgaggaaggcgctaagacggctcctggaaagaagagacccatagactctccagactcctccacgggcatcggcaaaaaaggccagcagcccgctaaaaagaagctcaattttggtcagactggcgactcagagtcagtccccgaccctcaacctcttggagaacctccagcagcgccctctagtgtgggatctggtacaatggctgcaggcggtggcgcaccaacggcagacaataacgaaggtgccgacggagtgggtaatgcctcaggaaattggcattgcgattccacatggctgggcgacagagtcatcaccaccagcaccagaacctgggccctccccacctacaacaaccacctctacaagcaaatctccagcagcagctcaggagccaccaatgacaaccactacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacaacgaatgacggcgtcacgaccatcgctaataaccttaccagcacggttcaggtcttctcggactcggaataccagctgccgtacgtcctcggctctgcgcaccagggctgcctgcctccgttcccggcggacgtcttcatgattcctcagtacggctacctgactctgaacaacggcagccaatcggtgggccgttcctccttctactgcctggaatatttcccctctcaaatgctgagaacgggcaacaactttgagttcagttacagcttcgaggacgtgcctttccacagcagctacgcgcacagccagagcctagaccggctgatgaaccctctcatcgaccagtacctgtactacctggcccggacccagagcaccacgggttccaccagggaactgcaatttcatcaagctgggcccaatactatggccgagcagtcaaagaactggctgcctggaccctgctataggcaacagagactgtcaaagaacttggactttaacaacaacagcaattttgcctggactgctgccactaaatatcatctgaatggcagaaactctttgaccaatcctggcattcccatggcaaccaacaaggatgatgaggaccagttctttcccatcaacggggtactggtttttggcaagacgggagctgccaacaaaactacgctggaaaacgttctgatgaccagcgaggaggagatcaagaccactaaccctgtggctacagaagaatacggtgtggtctccagcaacctgcagtcgtctacagccgggcctcaatcacagactatcaacagccagggagcactgcctggcatggtctggcagaaccgggacgtgtatctgcagggtcccatctgggccaaaattcctcacacggatggcaactttcacccgtctcctctgatgggcggttttggactcgaacacccgcctccacagatcctgatcaaaaacacacctgtacctgctaatcctccggaggtgtttactcctgccaagtttgcctccttcatcacgcagtacagcaccggacaagtcagcgtggaaatcgagtgggagctgcagaaagaaaacagcaagcgctggaacccagaaattcagtatacttccaattatgccaagtctaataatgttgaatttgctgtgaaccctgatggtgtttatactgagcctcgccccattggcactcgttacctcacccgtaatctgtaa

SEQ ID NO: 270 - DNA, 2190 bp, Non-human primate Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctggaaagaagagacccataggctctccagactcctccacgggcatcggcaaaaaaggccagcagcccgctaaaaagaagctcaattttggtcagactggcgactcagagtcagtccccgaccctcaacctcttggagaacctccagcagcgccctctagtgtgggatctggtacaatggctgcaggcggtggcgcaccaatggcagacaataacgaaggtgccgacggagtgggtaatgcctcaggaaattggcattgcgattccacatggctgggcgacagagtcatcaccaccagcaccagaacctgggccctccccacctacaacaaccacctctacaagcaaatctccagcagcagctcaggagccaccaatgacaaccactacttcggctacagcaccccctgggggtattttgactttaacagattccactgccacttctcaccacgtgactggcagcgactcatcaacaacaactggggattccggcccaagaagctgcggttcaagctcctcaacatccaggtcaaggaggtcacaacgaatgacggcgtcacgaccatcgctaataaccttaccagcacggttcaggtcttctcggactcggaataccagctgccgtacgtcctcggctctgcgcaccagggctgcctgcctccgttcccggcggacgtcttcatgattcctcagtacggctacctgactctggacaacggcagccaatcggtgggccgttcctccttctactgcctggaatatttcccctctcaaatgctgagaacgggcaacaactttgagttcagttacagcttcgaggacgtgcctttccacagcagctacgcgcacagccagagcctagaccggctgatgaaccctctcatcgaccagtacctgtactacctggcccggacccagagcaccacgggttccaccagggaactgcaatttcatcaagctgggcccaatactatggccgagcagtcaaagaactggctgcctggaccctgctataggcaacagagactgtcaaagaacttggactttaacaacaacagcaattttgcctggactgctgccactaaatatcatctgaatggcagaaactctttgaccaatcctggcattcccatggcaaccaacaaggatgatgaggaccagttctttcccatcaacggggtactggtttttggcaagacgggagctgccaacaaaactacgctggaaaacgttctgatgaccagcgaggaggagatcaagaccactaaccctgtggctacagaagaatacggtgtggtctccagcaacctgcagtcgtctacagccgggcctcaatcacagactatcaacagccagggagcactgcctggcatggtctggcagaaccgggacgtgtatctgcagggtcccatctgggccaaaattcctcacacggatggcaactttcacccgtctcctctgatgggcggttttggactcaaacacccgcctccacagatcctgatcaaaaacacacctgtacctgctaatcctccggaggtgtttactcctgccaagtttgcctccttcatcacgcagtacagcaccggacaagtcagcgtggaaatcgagtgggagctgcagaaagaaaacagcaagcgctggaacccagaaattcagtatacttccaattatgccaagtctaataatgttgaatttgctgtgaaccctgatggtgtttatactgagcctcgccccattggcactcgttacctcacccgtaatctgtaa

SEQ ID NO: 271 - DNA, 2190 bp, Non-human primate Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctggaaagaagagacccatagactctccagactcctccacgggcatcggcaaaaaaggccagcagcccgctaaaaagaagctcaattttggtcagactggcgactcagagtcagtccccgaccctcaacctcttggagaacctccagcagcgccctctagtgtgggatctggtacaatggctgcaggcggtggcgcaccaatggcagacaataacgaaggtgccgacggagtgggtaatgcctcaggaaattggcattgcgattccacatggctgggcgacagagtcatcaccaccagcaccagaacctgggccctccccacctacaacaaccacctctacaagcaaatctccagcagcagctcaggagccaccaatgacaaccactacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacaacgaatgacggcgtcacgaccatcgctaataaccttaccagcacggttcaggtcttctcggactcggaataccagctgccgtacgtcctcggctctgcgcaccagggctgcctgcctccgttcccggcggacgtcttcatgattcctcagtacggctacctgactctgaacaacggcagccaatcggtgggccgttcctccttctactgcctggaatatttcccctctcaaatgctgagaacgggcaacaactttgagttcagttacagcttcgaggacgtgcctttccacagcagctacgcgcacagccagagcctagaccggctgatgaaccctctcatcgaccagtacctgtactacctggcccggacccagagcaccacgggttccaccagggaactgcaatttcatcaagctgggcccaatactatggccgagcagtcaaagaactggctgcctggaccctgctataggcaacagggactgtcaaagaacttggactttaacaacaacagcaattttgcctggactgctgccactaaatatcatctgaatggcagaaactctttgaccaatcctggcattcccatggcaaccaacaaggatgatgaggaccagttctttcccatcaacggggtactggtttttggcaagacgggagctgccaacaaaactacgctggaaaacgttctgatgaccagcgaggaggagatcaagaccactaaccctgtggctacagaagaatacggtgtggtctccagcaacctgcagccgtctacagccgggcctcaatcacagactatcaacagccagggagcactgcctggcatggtctggcagaaccgggacgtgtatctgcagggtcccatctgggccaaaattcctcacacggatggcaactttcacccgtctcctctgatgggcggttttggactcaaacacccgcctccacagatcctgatcaaaaacacacctgtacctgctaatcctccggaggtgtttactcctgccaagtttgcctccttcatcacgcagtacagcaccggacaagtcagcgtggaaatcgagtgggagctgcagaaagaaaacagcaagcgctggaacccagaaattcagtatacttccaattatgccaagtctaataatgttgaatttgctgtgaaccctgatggtgtttatactgagcctcgccccattggcactcgttacctcccccgtaatctgtaa

SEQ ID NO: 272 - DNA, 2202 bp, Non-human primate Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacgagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgcctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaacggcttacaactttgagaaggtgccgttccactcaatgtatgctcacagccagagcctggacggactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaagaagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgcctatcctgcgacaaccttcactgcagccagagtggactctttcatcacacaatacagcaccggccaggtcgctgttcagattgaatgggaaatcgaaaaggaacgctccaaacgctggaatcctgaagtgcagtttacttcaaactgtgggaaccagtcttctatgttgtgggctcccgatacaactgggaagtatacagagccgcgggttattggctctcgttatttgactaatcatttgtaa

SEQ ID NO: 273 - DNA, 2202 bp, Non-human primate Adeno-associated virus
atggctgctgacggttatcttccagattggctcgaggacaacctctctgagggcattcgcgagtggtgggacctgaaacctggagcccccaagctcaaggccaaccagcagaagcaggacgacggccggggtctggtgcttcctggctacaagtacctcggacccttccacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaaccactgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgcctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgagaaggtgccgttccactcaatgtatgctcacagccagagcctggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaaggagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgccggaatcctgaagtgcagtttacttcaaactatgggaaccagtcttctatgttgtgggctcccgatacaactgggaagtatacagagccgcgggttattggctctcgttatttgactaatcatttgtaa

SEQ ID NO: 274 - DNA, 2202 bp, Non-human primate Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgtctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgggaaggtgccgttccactcaatgtatgcttacagccagagcccggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagactctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaagaagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgctggaatcctgaagtgcagtttacttcaaactatgggaaccagtcttctatgttgtgggctcccgatacaactgggaagtatacagagccgcgggttattggctctcgttatttgactaatcatttgtaa

SEQ ID NO: 275 - DNA, 2202 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtagcctgtaa

SEQ ID NO: 276 - DNA, 2058 bp, Non-human primate Adeno-associated virus
atggctgccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgacgaaccccctcatcgaccagtacctgtactacctggcccggacccagagcactacggggtccacaagggggctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaagtatacttccaactactacaaatctacaaatgtggactttgctgtcaatactgagggtacttattcagagcctcgccccattggcacccgttacctcacccgtaacctgtaa

SEQ ID NO: 277 - DNA, 2187 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcggcagagactgtcaaaagacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagagaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 278 - DNA, 2217 bp, Non-human primate Adeno-associated virus
atggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtccccggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaa

SEQ ID NO: 279 - DNA, 2208 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccagaaagctgcggttcaagttgttcaacatccaggtcaaggaggtcacgacggacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcatagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatggacggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 280 - DNA, 2217 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 281 - DNA, 2196 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccgggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaaccggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctaccagtttgaggacgtgccctttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggcctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 282 - DNA, 2196 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcatcacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccggctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagccggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 283 - DNA, 2202 bp, Non-human primate Adeno-associated virus
atggctgccgatggtcatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacagctggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 284 - DNA, 2187 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 285 - DNA, 2202 bp, Non-human primate Adeno-associated virus
atggctgccgatggttatcttccagattggctcgaggacaacctctctgagggcattcgcgagtggtgggacttgagacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagagactcaactttgggcagactggcgactcagagtcagtgcccgaccctcaaccaatcggagaaccccccgcaggcccctctggtctgggatctggcacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtagactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 286 - DNA, 2217 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaa

SEQ ID NO: 287 - DNA, 2187 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgctgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctatgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgagggccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccaggggtgtttactcctgccttgtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 288 - DNA, 2187 bp, Non-human primate Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 289 - DNA, 2187 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggcttccggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctgctgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccgtggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttccttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccggacacagactgtcaacagccagggggctctgcccggcatggtctggcagaaccgggacgtgtacctgcagggtcccatctgggccgaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 290 - DNA, 2187 bp, Non-human primate Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcagacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaagtcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcagctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgtgcacagccagagcctagaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtgcctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 291 - DNA, 2214 bp, Non-human primate Adeno-associated virus
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaatgcgggtgacaacccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaagggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacgagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtgacccaggaggcacagctggcaatcgggaactgcagttttaccagggcgggccttcaactatggccgaacaagccaagaattggttacctggaccctgcttccggcaacaaagggtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctgggacccggagattcagtacacctccaactttgaaaagcagactggtgtggactttgccgttgacagccagggtgtttactctgagcctcgccctattggcactcgttacctcacccgtaatctgtaa

SEQ ID NO: 292 - DNA, 2208 bp, Non-human primate Adeno-associated virus
atggctgccgatggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaa

SEQ ID NO: 293 - DNA, 2217 bp, Non-human primate Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacggagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagcctcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaatgacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaa

SEQ ID NO: 294 - DNA, 2217 bp, Non-human primate Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcggacgagcagtcttccaggccaagaagcgggttctcgaacctctcggtctggttgaggaaggcgctaagacggctcctggaaagaagagaccggtagagccatcaccccagcgttctccagactccactacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcgccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaaggcaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatggggggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaa

SEQ ID NO: 295 - DNA, 1932 bp, Non-human primate Adeno-associated virus
  modified_base (1301)..(1301): a, c, t, g, unknown or other
  misc_feature (1301)..(1301): n is a, c, g, or t
aaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatgnaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 296 - DNA, 1932 bp, Non-human primate Adeno-associated virus
aaggcctacgaccagcagctcaaagcgggtgacaatccgtacctgcggtataaccacgccgacgccgagtttcaggagtgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggttgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttctccccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacgccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 297 - DNA, 1932 bp, Non-human primate Adeno-associated virus
aaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagccagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacacggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctgggccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgaatgggagctgcagaaagagaacagcaagcgctggaacccagagattcagtacacctccaactttgacaaacagactggagtggactttgctgttgacagccagggtgtttactctgagcct

SEQ ID NO: 298 - DNA, 2538 bp, Non-human primate Adeno-associated virus
caggtgcctgtgccccacgtgttcagcgtcccgacatgttccgcggcggccgttcaaaagcgcccgacctcgcccagtccgccatttcacggcgagacagcgagggacgcggatcggaagacgcgcaagaagcccaggtatgatcgccctaaaccggaaccagcgaaagaccagaactgtctggacaagtggctcgaggagtctcccccgccgagaccctcggtagtccacgacctccaggactctggggacactgtgttcgattttcgggtggtgcgggaggtggagtgccccgattctaataaagagcaataaaatgattgatttgtagccatgtcttttttcgattggataggtcgtaagtacgccaacggcgccgctgagttctgggatctcgagccgggtcctccgaagcccaaaaaggccagagtcgacgactcggccggcttcaacttccccgggcacaagtacttgggccccggcaacggtctcgaccgaggggagcccgtggatgccgacgacgcggcggcccagaaacacgaccaggaatatcaggctctgcttgagagcggtgagaatccttacctcacttttaatcacgctgatcggcagctgcagaaggacctcgcggaggaccaatctttcgaggggaacctcgcccggggtctgttcgaagccaagaagctcgcggcacaggtcgtaggcgtcgaggagccggagctggctcctccagtcaagcgtccacactcgcccgagaaaaccccagagaaccagaagggtcagccgcgaccggatccccggacgccggccaagaagaggctcgagttctccgatcagcctggatcttcagcagacttacctgcatcctcacaacagtcccagcctcccgcaggggttcccggtgtggttcctggtacgatgtctgcaggaggaggcgctccagtggacgatgctcaacaaggtgccgacggagtgggcaatgcctcgggagattggcattgcgattccaaatggctgggcaaccgagttctcacccgatccacccggacctgggtgctgcccagctacaacaaccacctgtacaagcagatctcagacgcctccggcgtgcacagcctccccgggagccgatactttggctacagcaccccctgggggtacttcgacttcaatcgcttccactgccacttctcgcccagagactggcagcgcctcgtcaataaccactggggcttccgacccaagagactgcgagtcaaactcttcaacatccaggtcaaggaggtcacgactactgattcgacgaccacggtctccaacaacctcacgagcacggtccaggtcttcacagacgacgagtaccagctgccgtacgtctgcggcaacgccaccgagggatgcctgccgccgttccccccggacgtcttcacgctgccgcagtacggctacgcgacgctgaacgacagcaacaatggcaaccccaccaacagatcgagcttcttctgtctggaatactttcccagcaagatgctgagaaccgggaacaactttgaatttaccttcgagtttgaagacgtgcccttccacacgggcttcgccccctgtcagaacctgttcaagctgagcaatcccctggtggaccagtacctgtaccgcttccagggtactgacaactcctccagcagcacgcccggggtggtcaagttcgagaaatgcgtggcccacaactacgcccagcagtacaagaactggctgaccggtgctttccagaggaaccaggactataactacgtgtctggtactagcaactacaagggcgtggttggatctaatcagaataacctgcagcgcatagagaatgtgcagttcgccattgctccggacgtgcccagcatgtgtaaccatctggagggcaccaatatgatcgctctggacaacagcctgatcttccgggatgtctctaccgcccctggtgacacgactcagtataacatcaaccaggtgatcgtgaccagcgaagccgagactcaatctgtcaatgcgtactcgggcgacacctgtggccgcattgtgaataacagccagaatagcggaaccaacgctgggaccaccggcatcaactacaaaggtaccatgccgtcctcggtctggatggaccgtgacgtctacctgcagggcccgatctgggccaagattccccacacgggggcgcactttcacccgtctcccatgatggggggcttcggcctgaggaaccctcctccgatgatgctgatcaagaacacgcccgttcctggcaacgtgaccaccttcaccgaggtcaaggttaaccagttcatcacccagtactcgaccgggcagatcaccgtggacgtggaatgggagctgcagaaggagaactccaaacgatggaaccccgagatccagtacacaaataactacagtaataatacttttgtggactttgcccccaatgctaatggagattaccagatgacccgccccattggaacccgctacccgacccgccccccgtaa

SEQ ID NO: 299 - DNA, 2211 bp, Rat adeno-associated virus
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctcctgccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 300 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKRRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 301 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGVDGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKLASFITQYSTGQVSVEIEWELQKENSKRWNPEVQYTSNYAKSANVDFTVDNNGLYTEPRPIGTRYLTRPL

SEQ ID NO: 302 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVGEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 303 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGGSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 304 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 305 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQQLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSTSTDPATGDVHAMGALPGMVWQDRDVYLQGPIWAKIPHTDGHFHPSPLMGGFGLKNPPPQILIKNTPVPANPPAEFSATKFASFITYSTGQVSVEIEWELQKENSKRWNPEVQYTSNYAKSADVDFTVDNNGLYTEPRPIGTRYLTRPL

SEQ ID NO: 306 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQPPYVLGSAHQGCLPPFPADVFMIPQYGHLTLNNGSQAVGRSSFYCLEYFPSQMLRTGNNFTFSYTFEEVPFHSSYAHSQSLDRLTNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 307 - protein, 736 aa, Artificial Sequence
  Description of Artificial Sequence: Synthetic polypeptide
MAADGYLPDWLEDNLSEGIREWWDLKPGAPKPKANQQEQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHATGTLPGMVWQDRDVYLQGPIWAKIPHTDGHFHPSPLMGGFGLKNPPPQILIKTTPVPANPPAEFSATKFASFITQYSTGQVSVEIEWELQKENSKRWNPEVQYTSNYAKSANVDFTVDDNGLYTEPRPIGTRYLTRPL

SEQ ID NO: 308 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSLQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNDNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 309 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPRPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGPPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 310 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEAPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPVGTRYLTRPL

SEQ ID NO: 311 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNAPGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITGEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 312 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGTSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTGPRPIGTRYLTRPL

SEQ ID NO: 313 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNSTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGTLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 314 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVSAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKERLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 315 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEGEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 316 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQENTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFPPRDWQRLINNNWGFRPKRLNFKLFNIQVKEVTSNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 317 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 318 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCPEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 319 - protein, 736 aa, Artificial Sequence
  Description of Artificial Sequence: Synthetic polypeptide
  MOD_RES (102)..(102): Any amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQXRLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGHSTPWGYFDFNRFHCHFSPRDWQRLINNNWGFRPKRLNFKLFNIQVKEVTTNDGVTTIANNLTSTVQVFSDSEYQLPYVLGSAHQGCLPPSPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 320 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSDTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 321 - protein, 736 aa, Artificial Sequence
  Description of Artificial Sequence: Synthetic polypeptide
MAADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYGHSQSLDRLMNLLIDQYLYYLNRTQNQSGSAQNKDLLFSRGSPAGMFVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 322 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLMLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPAATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 323 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 324 - protein, 736 aa, Artificial Sequence
  Description of Artificial Sequence: Synthetic polypeptide
MAADGYFPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGRTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSPDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYSEPRPIGTRYLTRPL

SEQ ID NO: 325 - protein, 736 aa, Artificial Sequence
  Description of Artificial Sequence: Synthetic polypeptide
MAADGYPPDWLEDNLSEGIREWWDLKPGVPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 326 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQTSSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDYNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 327 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQAFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDPYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 328 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDLYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGTSNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 329 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHSHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 330 - protein, 736 aa, Artificial Sequence
  Description of Artificial Sequence: Synthetic polypeptide
MAADGYLPDWLEDSLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTPNNGSQAVGRSSFYCLEYFPSQMLRTGNNFTFSYTFEEVPFHSSYAHSQSLDRLMNPLIDQYQYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 331 - protein, 736 aa, Adeno-associated virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 332 - protein, 736 aa, Artificial Sequence
  Description of Artificial Sequence: Synthetic polypeptide
MAADGYLPDWLEDNLSEGIREWWALKPGAPQPKANQQHQDNARGLVLPDYKYLGPGNGLDKGEPVNAADVAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDGVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLPKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 333 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKRRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQIKEVTDNNGVKTIANNLTSTVQVFTDLDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 334 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVSDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPSPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDDVDADKVIITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 335 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHAGAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGAGGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHGGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRSYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 336 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSHAHSQSLDRLMNPLIDQYLHYLSKTINGSGQNQQTLKFSVAGHSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIGWELQKENSKRWNPEIQYTSNYYKSNNVEFAVNTEGVYSEPRPIGTRYLTRNL

SEQ ID NO: 337 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNRLYKQISNSTSGGSSNDNAYFGYSTPWGYFDFNRFHCHFSPRDWQRLINNNWGFRPKRLNFKPFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 338 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 339 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFGYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWDPEIQYTSNYYKSNNVEFAVNTEGVYSEPRPIGTRYLTRNL

SEQ ID NO: 340 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCRFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNAPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 341 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 342 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNTAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 343 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGSNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPAATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQHTSNYYKSNNVEFAVNTEGVYSEPRPIGTRYLTRNL

SEQ ID NO: 344 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFRLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQSQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 345 - protein, 735 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWRYFDFNRFHCHFSPRDWQRLINNWGFRPKRLNFKLFNIQVKEVTDNNGVKTIANNLTSTVQAFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDELNSFITQYSTGQVSVEIEWELQKENSKRWNPEIQYTSNYYKSNNVEFAVNTEGVYSEPRPIGTRYLTRNL

SEQ ID NO: 346 - protein, 735 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQDKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 347 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRAITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMTTNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 348 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALVHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFTIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGPRYLTRNF

SEQ ID NO: 349 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 350 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFELFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQSSYEFENVPFHSSYAHSQSLDRLMNPLIDQYLYYLSKTINGSGQNQQTLKFSVAGPSNMAVQGRNYIPGPSYRQQRASTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 351 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPPGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTISGSGQNQQTLKFSVAGPSNMAVQGRNYIPGPSYRQQRVSTTVTQNNSSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILSGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 352 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 353 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLDYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQGRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 354 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQTKKRLLEPLGLVEEAAKTAPGKKRPVEQSPQEPGSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 355 - protein, 736 aa, Artificial Sequence
  Description of Artificial Sequence: Synthetic polypeptide
MAADGYFPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGESPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYLPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAVASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 356 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQAATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 357 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWRRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 358 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNLYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 359 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 360 - protein, 736 aa, Artificial Sequence
  Description of Artificial Sequence: Synthetic polypeptide
  MOD_RES (442)..(442): Any amino acid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISTSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDXYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPDMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 361 - protein, 736 aa, Artificial Sequence
  Description of Artificial Sequence: Synthetic polypeptide
MAADGYLPDWLEDNLSEGIREWWALKPGAPQPRANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDCQLPYVLGSAHEGCLPPFPADVFMIPQYGYLTLNDGSQAVGRSSFYCLEYFPSQMLRTGNNFQFSYEFENVPFHSSYAHSQSLDRLTNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESHGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 362 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPPIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYGEPRPIGTRYLTRNL

SEQ ID NO: 363 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDRQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 364 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCNSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPGNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 365 - protein, 736 aa, Artificial Sequence
  Description of Artificial Sequence: Synthetic polypeptide
MAADGYLPDWLEDNLSEGIREWWALKPGAPQPKANQQHQDNARGLVLPGYRYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTVANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSGPRPIGTRYLTRNL

SEQ ID NO: 366 - protein, 736 aa, Artificial Sequence
  Description of Artificial Sequence: Synthetic polypeptide
MAADGYLPDWLEDNLSEGIREWWALKPGAPQPKANQQRQDNARGLVLPGYKYLGPGNGLDKGEPVNAADAAALEHDKAYDQQLKAGGNPCLKYNHADAEFQERLKEDTSFGGNLGRAVFQAKKRLLEPLGLVEEAAKTAPGKKRPVEQSPQEPDSSAGIGRSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKAIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIDGSGQNQQTLKFSVAGPSNMAVQGRNYIPGPSYRQQRVSTTVTQNNNSEFAWPGASSWALNGRNSLMDPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTGGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 367 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKPNNVEFAVNTEGVYSEPRPIGTRYLTRNL

SEQ ID NO: 368 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRPLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPTMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 369 - protein, 736 aa, Artificial Sequence
  Description of Artificial Sequence: Synthetic polypeptide
MAADGYPPDWLEDNLSEGIREWWALKPGAPQPKANQQHQDNARGLVLPGYKYLGPGNGLDKGEPVNAADAAALEHDKAYDQQLKAGDNPHLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDRLNSFITQYSTGQVSVEIEWELQKENSKRWNPEIQYTSNYYKSNNVEFAVNTEGVYSEPRPIGTRYLTRNL

SEQ ID NO: 370 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 371 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLTNNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYIPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 372 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLISGKQGTGRDNVDANKVMITNEEEIKTTNPVATESYGQVATNHQSAQAQAQTGWVQNQGILPGMVWQDRDVYLQGPIWAKIPHTDGNFHPSPLMGGFEMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 373 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTEPVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPAGVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTATQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 374 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAGFQERLKEDTSFGGNLGRAVFQAKKRLLEPLGLVEEAAKTAPGKKRPVEQSPQEPDSSAGIGKSGAQPAKKRLNFGQTGDTESVPVPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGAGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 375 - protein, 736 aa, Artificial Sequence
  Description of Artificial Sequence: Synthetic polypeptide
  MOD_RES (126)..(126): Any amino acid
MAADGYLPDWLEDNLSEGIRERWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLXEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSPDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 376 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLDSFITQYSTGQVSVEIEWELQKENSKRWNPVIQYTSNYYKSNNVEFAVNTEGVYSEPRPIGTRYLTRNL

SEQ ID NO: 377 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 378 - protein, 731 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTIASGGGAPVADNNEGADGVGSSSGNWHCDSQWLGDRVITTSTRTWALPTYNNHLYKRISNSTSGGSSNDNAYFGYSTPWGYFDFNRFHCHFSPRDWQRLINNNWGFRPKRLNFKLFNIRVKEVTDNNGVKTITNNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTRNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWFKTKEYFRVWFGRTEMCTCKDPFGPKFLTRTATFTLLRWEGLESTRLLRSSSKTHLYLRILQRPSTRTSTLSSPSILLAKSAWRSSGSCRRKTASAGTRRSSTLPTITSLIMLNLLLILKVYIVNPAPLAPDTLVI

SEQ ID NO: 379 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSRAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 380 - DNA, 2217 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttcctccaacgggacatcgggaggagccaccaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 381 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccaacagcacatctggaggatcttcaaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 382 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccaacggcacctcgggaggaagcaccaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 383 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccaacgggagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 384 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaaggaacctcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 385 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcatcgggaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 386 - protein, 738 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSNGTSGGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 387 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISNSTSGGSSNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 388 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISNGTSGGSTNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 389 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISNGSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 390 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQGTSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 391 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSSGGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 392 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacacaaacaacaggaggcacggcaaatacgcagactcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 393 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacacaaacaacaggaggcacgacaaatacgcagactcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 394 - DNA, 2205 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacacaaacgactggaactggagggacgcagactcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 395 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactattaacggttctggacagaatcaacaaacgcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 396 - DNA, 2205 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaattaacggttctggacagaatcaacaaacgcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 397 - DNA, 2205 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 398 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTQTTGGTANTQTLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 399 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTQTTGGTTNTQTLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 400 - protein, 734 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTQTTGTGGTQTLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 401 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTINGSGQNQQTLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 402 - protein, 734 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTINGSGQNQQTLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 403 - protein, 734 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 404 - DNA, 2217 bp, Non-human primate Adeno-associated virus; identical to SEQ ID NO: 286

SEQ ID NO: 405 - DNA, 2202 bp, Adeno-associated virus
atggctgctgacggttatcttccagattggctcgaggacaacctctctgagggcattcgcgagtggtgggacctgaaacctggagccccgaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaaaacggctcctggaaagaagagaccgttagagtcaccacaagagcccgactcctcctcgggcatcggcaaaaaaggcaaacaaccagccagaaagaggctcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcgtctcggaacaacatcaagcagcaacacctacaacggattctccaccccctggggatattttgacttcaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagaggggagcctgcctcctttccccaatgacgtgttcatggtgcctcaatatggctactgtggcatcgtgactggcgagaatcagaaccaaacggacagaaacgctttctactgcctggagtattttccttcgcaaatgttgagaactggcaacaactttgaaatggcttacaactttgagaaggtgccgttccactcaatgtatgctcacagccagagcctggacagactgatgaatcccctcctggaccagtacctgtggcacttacagtcgactacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatcgcgcccggacctccaatggccacagccggaccttcggatggggacttcagtaacgcccagcttatattccctggaccatctgttaccggaaatacaacaacttcagccaacaatctgttgtttacatcagaagaagaaattgctgccaccaacccaagagacacggacatgtttggccagattgctgacaataatcagaatgctacaactgctcccataaccggcaacgtgactgctatgggagtgctgcctggcatggtgtggcaaaacagagacatttactaccaagggccaatttgggccaagatcccacacgcggacggacattttcatccttcaccgctgattggtgggtttggactgaaacacccgcctccccagatattcatcaagaacactcccgtacctgccaatcctgcgacaaccttcactgcagccagagtggactctttcatcacacaatacagcaccggccaggtcgctgttcagattgaatgggaaattgaaaaggaacgctccaaacgctggaatcctgaagtgcagtttacttcaaactatgggaaccagtcttctatgttgtgggctcctgatacaactgggaagtatacagagccgcgggttattggctctcgttatttgactaatcatttgtaa

SEQ ID NO: 406 - DNA, 2229 bp, Adeno-associated virus
atggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgcccattagaaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatgcgtgcggcgccaggcggaaatgctgtcgaggcgggacaaggtgccgatggagtgggtaatgcctccggtgattggcattgcgattccacctggtcagagggccgagtcaccaccaccagcacccgaacctgggtcctacccacgtacaacaaccacctgtacctgcgaatcggaacaacggccaacagcaacacctacaacggattctccaccccctggggatactttgactttaaccgcttccactgccacttttccccacgcgactggcagcgactcatcaacaacaactggggactcaggccgaaatcgatgcgtgttaaaatcttcaacatacaggtcaaggaggtcacgacgtcaaacggcgagactacggtcgctaataaccttaccagcacggttcagatctttgcggattcgacgtatgaactcccatacgtgatggacgccggtcaggaggggagctttcctccgtttcccaacgacgtctttatggttccccaatacggatactgcggagttgtcactggaaaaaaccagaaccagacagacagaaatgccttttactgcctggaatactttccatcccaaatgctaagaactggcaacaattttgaagtcagttaccaatttgaaaaagttcctttccattcaatgtacgcgcacagccagagcctggacagaatgatgaatcctttactggatcagtacctgtggcatctgcaatcgaccactaccggaaattcccttaatcaaggaacagctaccaccacgtacgggaaaattaccactggagactttgcctactacaggaaaaactggttgcctggagcctgcattaaacaacaaaaattttcaaagaatgccaatcaaaactacaagattcccgccagcgggggagacgcccttttaaagtatgacacgcataccactctaaatgggcgatggagtaacatggctcctggacctccaatggcaaccgcaggtgccggggactcggattttagcaacagccagctgatctttgccggacccaatccgagcggtaacacgaccacatcttcaaacaatttgttgtttacctcagaagaggagattgccacaacaaacccacgagacacggacatgtttggacagattgcagataataatcaaaatgccaccaccgcccctcacatcgctaacctggacgctatgggaattgttcccggaatggtctggcaaaacagagacatctactaccagggccctatttgggccaaggtccctcacacggacggacactttcacccttcgccgctgatgggaggatttggactgaaacacccgcctccacagattttcatcaaaaacacccccgtacccgccaatcccaatactacctttagcgctgcaaggattaattcttttctgacgcagtacagcaccggacaagttgccgttcagatcgactgggaaattcagaaggagcattccaaacgctggaatcccgaagttcaatttacttcaaactacggcactcaaaattctatgctgtgggctcccgacaatgctggcaactaccacgaactccgggctattgggtcccgtttcctcacccaccacttgtaa

SEQ ID NO: 407 - DNA, 2217 bp, Artificial Sequence
  Description of Artificial Sequence: Synthetic polynucleotide
atgtctctcatttctgatgcgattccagattggttggagcggttggtcaaaaagggagtgaatgctgcggctgatttctaccatttggaaagcggtcctcctcatcctaaggcaaatcagcaaactcaagaatctcctgaaaaggacgattcgagaggtctcgtgttcccgggttacaagtatctaggccctttcaacggtctagataaaggaaaacccgtcaacgaggcagacgctgccgccttagagcacgacaaggcttacgacctcgaactcaaggacgggcacaacccgtactttgagtacaacgaggccgatagacgtttccaggaacgtctcaaagacgatacctctttcggagggaatctcggtaaagccatctttcaggccaaaaagagggtcctcgagccctttggtctgattgaacaacccgacaacacggccgggaccggggagaagcgtcccgaacgcgtcgacgactttttcccgaaaaagaagaaggccaagaccgagcaaggcaaagcccctgctcaaacgggcgaagaccccggagaaggaacctcttccaacgctggatcaagcgccccctctagtgtgggatcatctgtcatggctgaaggaggtggcggtccaatgggcgatgcaggccaaggtgccgacggagtgggcaattcctcgggaaattggcattgcgattcccaatggctggacaacggagtcgttacccgaaccactcgaacctgggtcctgcccagctacaacaaccacttgtacaagcggatccaaggaccgggaggaaccgaccccaacaataaattctttggattcagcaccccctgggggtactttgactacaaccgattccactgccacttctccccccgagactggcaacgactcatcaacaacaactggggcatccgacccaaagcgatgcgctttagactctttaacatccaggttaaagaagtcactgtccaagactccaacaccaccatcgccaacaacctcaccagcacggtccaagtctttgcggacaaggactaccagctgccgtacgtcctcggatcggctacagagggcaccttcccgccgttcccagcggatatctacacgatcccgcagtatggttactgcacgctaaactacaacaacgaggcggtggatcgttcggccttctactgtctagactatttcccctcagacatgctgcggacaggaaataactttgaattcacttacacgttcgaggacgttcctttccatagcatgtttgctcacaaccagacgctagaccggctgatgaatcctctcgtcgatcagtacctgtgggctttcagttccgtcagccaaacaggctcgtctggacgggcactcaattattcacgcgcgaccaaaaccaatatggcaacccagtacagaaactggttacctggacccttcgtccgggatcagcaaatctttacgggggctagcaacatcacccaaaacaacgtgttcaacgtttgggataaaggcaagcagtgggtgatagacaatcggatcaatatgatgcagcccggccctgcagcagcgaccacctttagcggagaacccgaccgtcaagccatgcaaaacacgctggcctttagtcggacggtctacgaccagacaaccagtacgaccgatcgtaaccagttgctcattaccaacgaagatgaaatcagacccaccaactcggtcggcatcgacacgtggggagtagttcccaacaacaaccagtccaaggtgaccgccggcactcgcgcggccatcaacaaccaaggggcgcttcccgggatggtgtggcaaaacagagacatttacctccaaggacccatttgggccaaaatccccgacacagacaatcacttccatccgtccccgcttattggcgggtttggctgcaagcatccccctccccagattttcattaaaaacacacccgtcccggccaacccttcggaaacgttccagacggccaaggtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgctgtctccgacaccggatcctattccgaacctcgtcccatcggtacccggtaccttaccaaacctctgtaa

SEQ ID NO: 408 - DNA, 2175 bp, Artificial Sequence
  Description of Artificial Sequence: Synthetic polynucleotide
atgtcgtttgtcgatcaccccccagactggctcgaggagatcggagaggggctctccgagttcatcggactagaggcgggaccgccgaagcctaagccgggctaccaggaccgcgcgcgcggcctcgtcgtccccggctacaagtacctcgggcccttcaacggactcgacaggggcgagcccgtcaacgcggccgacgcggcggccaagaagcacgacgaggagtacgaccggctcctcaaggcgggggacaacccgtacctcgcctacaaccacgcggacgccgagttccagaaggacctcagcggcgactccagcctagccggcaacgccgcgaacgcgctcttccaggccaagaagagggtcctcgagcccttcggactggtcgagggagagccggagcccaagaagacgccttccgtcaagaggccgcacgcatcgccggactcgtcgagcggcgtcgggaagaagggcgaccagcccgcgcggaagaggctcgactttgggacggagcccgcgggtcaagacggagcgggacgagcggcccaggcagccggagatatggcatctgctgaggtggctgcgggtggtggcggaccagtgggcgacgatgcacaaggtgccgatggagtgggtaatgcctcaggaaattggcattacgattccgtttggatggacggcgctgtcatcaccaagtccacccgaacctggagcctgcccgcctacaacaaccacctctaccgccagatccagtccagcggcaccggagacggcacgtactttggttacagcacgccttggggatacttcgatttcaatcgattccactgccacttttctcccagggactggcagcggctcatcaacaaccactggggcatccgccccaagcggctccactttaagctcttcaacatccaggtcaaggaggtcacgacgaccgacggcaccacgaccatcgccaacaacctcaccagcaccatacaggtctttgcggacacggagtaccagctcccgtacgtgctcggcaacgcccacgagggctgcctgccgccgttcccggcggacgtcttcatgctgccgcagtacgcgtacctgacgctcaacgccaaccccacgaaccagggcgcggccgcgctcagcctgccgcagagcgccttctactgcctggagtactttccgagccagatgctgaggaccgggaacaacttctcgttcagctacgagttcgagaagctgcccttccactcgatgttcatgcacagccagagcctggaccggctcatgaacccgctcatcgaccagtacctctggtacctcaacgccacgaccggcaacaacctctccttcaacaaggccggcgccaagaacttccccgagtacttccgcaactggctgcccgggcccggccagcgcgtgcagcagtggagcacgatcggaacccagaacaacgcgcagaccggcacgtgggccagcgccaacaagtggatcctcatgggcaggtccagcaagatggcccccgggctggcccagccggtcaggaacgcccagaccgtcaccaacggctcgcagctcatcttcaacaacgagaccatcaagggctccaccgcgacggcctccaccgtacactcggggctgctcgtcaccaacgagtcggagaccgccccgaccaaccccaactcggcgacaaagtggggcgtcatgacggacaaccagcagaccacctccactacgccgaccgtcagcgacgacctcgaggcgcacgtcttcccgggcatggtctggcaggaccgcgacatctacctgcagggcccgatatgggccaagatcccggagacggacggccacttccacccgtccccgctcatgggcggcttcgggctcaagaacccgccgccgcagatcctcgtcaagaacacgcccgtgcccgccgtgccgcccacgaccttcacaccgcagaaggtcaactccttcatcacgcagtactccaccggccaggtcaccgtcgagatcgagtgggagctgcgcaaggagaagagcaagcgctggaaccccgagatccagtacacctccaacttcgagaactcggccaacgtacagttctccgtcaacggcgacggcgcgtacatcgagccgcgaccgatcggaacccggtacctcacccacaacctgtaa

SEQ ID NO: 409 - DNA, 2211 bp, Artificial Sequence
  Description of Artificial Sequence: Synthetic polynucleotide
atgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 410 - DNA, 2142 bp, Artificial Sequence
  Description of Artificial Sequence: Synthetic polynucleotide
atgtctttctttgattggttaggtaaacagtacgctcaaggagctgctgaattctgggatttgaagtccggtcctcctgcaccaaaaaaggcgcgaaaggacggatcagccggattcaatttccctgggcacaaatacctgggtcctggcaattcattggatcgcggagatcccgtggacgctgacgacgccgctgctcaaaagcacgaccagtcgtaccaagagcagcttgaggcgggagacaatccctacctcaagtacaaccacgccgaccgcgagttccaggaggcgttgaaggacgacacctcctttgaaggaaatctcgcgagaggactctttgaggccaagaagctcgtggcagagcctcttggtctcgtggaaccagaactggcgccacccagtggccgtaaacgaccggtgcaatcgagtcaagagtctggttactcgagtagccaagacaagcggcccaacctcgacgtagacgaggaggaccgtgagttcgctgccgctgcagcggagaccgaaactggaagcgctccccccaccggcaatttgggacctggtacgatggctggaggcggtagcgcgccaatcgacgacggctcgtatggtgccgatggagtgggcaatgcctcgggagattggcattgcgattccacatggctggacaactgtgtcatcacccgaaccactcggacctggaatctgccaacctacaacaaccacatctacaaacgactcaacggaacgacctccggagaccaaagctacttcggattcagcaccccctggggatactttgacttcaaccgcttccactgtcatttctcccctcgagactggcaaagactcatcaacaataactggggactccgaccaaagagcctacggttcaaaatctttaacattcaagttaaagaagtcacgacgcaagactcaacgaagatcatctccaataaccttaccagcacggttcaggtatttgcggacacggagtaccagctcccgtacgtgattggatcggctcacgaaggatgtctgcctcctttcccggctgacgtgttcatgctgccgcagtatggatactgtactcgacaagacggaaacagcaacaatccgaccccgagaagcgccttctattgtttggagtactttcccagcaagatgctaagaactgggaacagttttgaatttacatataactttgagaaggtgccgttccacagcatgtgggctcacaaccagagtctggatcgattgatgaatccattgattgatcagtacctgtactaccttgatgtcacttcgagtaccgggtttacctatcaaaaaggagttcacacgaacttgcccgaacaagagcgcaactggctgccgggaccaggaattcgaaatcaagcttggtttaattctgcaactggaaacaacccactaactggtacctggcaatattccaacaaatacgtacttgaaaaccgtgcttcgaagattgctcctggacctgccatgggaattgaatcaacaaaattcgacgggaacggaatcatcttttctaaagaatacatcaccaatgtaaatacagccaatccgaatcaagtaaacatcacacgcgagaccgaaataaactcaacgaaccccttggctggaggatctctcggagcccacgctaataattcacaaaacacaacaacggcaccgacgctagaccacaccaacgtcatgggtgtgtttccgggtagtgtctggcaagacagagacatttaccttcaaggacaaatctgggccaagattccccacacagacggacatttccacccttctcctctcatgggaggatttggactgaagaacccgcctcctcaaattctgatcaaaaacacacctgttccggctgacccaccaactgaattcaatgcgaacaaaatctcttctttcatcactcaatactcaaccggacaagttacagtggaaatggaatgggaacttcagaaagaaacctccaaaagatggaatccagaaatccagtacagcgacgactcgtcttcgacgtctggctccattctgcactttgctccggatgatgttggaaactacaaagagttccgctctatcggaactcgttaccttacccgtcctctgtaa

SEQ ID NO: 411 - DNA, 2205 bp, Artificial Sequence
  Description of Artificial Sequence: Synthetic polynucleotide
atgtcttttttcgattggataggtcgtaagtacgccaacggcgccgctgagttctgggatctcgagccgggtcctccgaagcccaaaaaggccagagtcgacgactcggccggcttcaacttccccgggcacaagtacttgggccccggcaacggtctcgaccgaggggagcccgtggatgccgacgacgcggcggcccagaaacacgaccaggaatatcaggctctgcttgagagcggtgagaatccttacctcacttttaatcacgctgatcggcagctgcagaaggacctcgcggaggaccaatctttcgaggggaacctcgcccggggtctgttcgaagccaagaagctcgcggcacaggtcgtaggcgtcgaggagccggagctggctcctccagtcaagcgtccacactcgcccgagaaaaccccagagaaccagaagggtcagccgcgaccggatccccggacgccggccaagaagaggctcgagttctccgatcagcctggatcttcagcagacttacctgcatcctcacaacagtcccagcctcccgcaggggttcccggtgtggttcctggtacgatgtctgcaggaggaggcgctccagtggacgatgctcaacaaggtgccgacggagtgggcaatgcctcgggagattggcattgcgattccaaatggctgggcaaccgagttctcacccgatccacccggacctgggtgctgcccagctacaacaaccacctgtacaagcagatctcagacgcctccggcgtgcacagcctccccgggagccgatactttggctacagcaccccctgggggtacttcgacttcaatcgcttccactgccacttctcgcccagagactggcagcgcctcgtcaataaccactggggcttccgacccaagagactgcgagtcaaactcttcaacatccaggtcaaggaggtcacgactactgattcgacgaccacggtctccaacaacctcacgagcacggtccaggtcttcacagacgacgagtaccagctgccgtacgtctgcggcaacgccaccgagggatgcctgccgccgttccccccggacgtcttcacgctgccgcagtacggctacgcgacgctgaacgacagcaacaatggcaaccccaccaacagatcgagcttcttctgtctggaatactttcccagcaagatgctgagaaccgggaacaactttgaatttaccttcgagtttgaagacgtgcccttccacacgggcttcgccccctgtcagaacctgttcaagctgagcaatcccctggtggaccagtacctgtaccgcttccagggtactgacaactcctccagcagcacgcccggggtggtcaagttcgagaaatgcgtggcccacaactacgcccagcagtacaagaactggctgaccggtgctttccagaggaaccaggactataactacgtgtctggtactagcaactacaagggcgtggttggatctaatcagaataacctgcagcgcatagagaatgtgcagttcgccattgctccggacgtgcccagcatgtgtaaccatctggagggcaccaatatgatcgctctggacaacagcctgatcttccgggatgtctctaccgcccctggtgacacgactcagtataacatcaaccaggtgatcgtgaccagcgaagccgagactcaatctgtcaatgcgtactcgggcgacacctgtggccgcattgtgaataacagccagaatagcggaaccaacgctgggaccaccggcatcaactacaaaggtaccatgccgtcctcggtctggatggaccgtgacgtctacctgcagggcccgatctgggccaagattccccacacgggggcgcactttcacccgtctcccatgatggggggcttcggcctgaggaaccctcctccgatgatgctgatcaagaacacgcccgttcctggcaacgtgaccaccttcaccgaggtcaaggttaaccagttcatcacccagtactcgaccgggcagatcaccgtggacgtggaatgggagctgcagaaggagaactccaaacgatggaaccccgagatccagtacacaaataactacagtaataatacttttgtggactttgcccccaatgctaatggagattaccagatgacccgccccattggaacccgctacccgacccgccccccgtaa

SEQ ID NO: 412 - DNA, 2157 bp, Artificial Sequence
  Description of Artificial Sequence: Synthetic polynucleotide
atgtcttctttgtttaaagagtacctgcagagtaccggactggtgggtatccagtcgggagcgccgaagccaaaggccggccagcagaagcaggatacagggtcctttgagtggaaaaagaaggaggacacagccagagggctggtccttcccggttacaagtacctcgggcccttcaacggtctagagcggggcgagcctgtgaatgccgcggacgccgcggcccagcgacacgaccgacagtacgatcgtattctacaacaagggggtaatccatacctcacgtacaaccacgccgaccgagagttccaggaggagctccagtctgacgagtcttttgggggaaatcttggcaaggctgtgtttcaggccaagaagcgaatcctagagcccctcggtctggttgaagaggatccctctcagccagattcgtcctcggacaacacggcgccacccgtgaaaaagtcccgtctcgaagaagcccagcccattcaaagtccagacgtttccagcagcactggcggaggaattgccgacgtcatgtctggagatgctgaaatggctgcagtgggcgggggagcaccgggcgtcgacggccagggtgccgagggagtgggtacttcctcgggtaattggcattgcgattcccagtggtcagaaggacacgtcagaaccaccagcaccagaacctgggtgttgcccagctacaacaaccacctgtataaacggcttggaagtagcgcacaatccaatacctacaacggattctccaccccctggggatacctcgacttcaatagatggcactgtcacttcagtcctcggaactggcaacgtctcatcaacaacaactggggcatcagaccaaaaagacttaatgttaaattgttcaacatacaagtcaaagaggtcacgacggaaggggggacgacgaccgtcgccaataaccttaccagcacgattcaggtgtttgcggacaacgcgtacgaactcccgtatgttgtcgacgcgggtcacgagggggcattgccgccgttcccaaacgacgtgtttatgattccccaatacggatactgcgggctggtgtctggtcaaagtcagaatcagtcggacttgtgttcgttttattgcctggagtattttccatcccagatgctgagaacaggaaacaattttgaaatgaatttcaggtttgaagacgttccatttcactccatgtacgcccacagccagtctctagacaggctcatgaatcctttaattgatcagtatctgtggagtctaaaacaaacaggaaacccgactggatcaacaacgagagacttaaaatttatcaagaacaaagttcccaattttgcacattatggaaaaaattggcttcctggaccttttattagacaacaggggtggacaacacaaaatattaataatagtgttgttaattttaatgacatgctgggaaaaaattcgacatttactttggacactagatggagttcattagcgcctggtccgtgtatgggggatgacggacgaactccatccaccaccaagttctcaaatgctcagctcatgtttggatctggaacacaacccaccgaaggcggtgaagatgctgtacatattacatccgagtcggaggtcaaggcaaccaacccaactgcaatcgatgaatacggacgagtggccgataatacgcaaaatgcaacaaccgccccaaccacagtgggaaatgctgcaatgggggccatgcctgggatggtgtggcaagatagggatatctatcttcaaggacccatctggggaaaaataccccatacagacggacattttcatccgtctcctctcatgggggggtttggatacagaaaaccccctccgcaaatttttattaaaaacacccccgttcctggaaatccggcaactacattttctccaaatagaataaacaatttcattactcaatactcaacgggacaagtgaccgttactattgactgggagctgcaaaaggaaaactcaaagagatggaacccagaagtacaatttacatcaaattttggcacggtcgattcactaaactgggcaccggacaacgcgggaaactacaaagaaccaagggtggtggggtctcgattccttacgcatatactataa

SEQ ID NO: 413 - DNA, 2181 bp, Artificial Sequence
  Description of Artificial Sequence: Synthetic polynucleotide
atggattttctcgatgatttctttgcagataaatataaagagactgttaacgaactcggtaaaccggtcaatcctaaacctgtaaaacacattagcgaagctcactcgcaacctggcagcaggaggggctttgtggtgcctgggtatcggtatcttgggcctggtaatagcttggaccgtggaaagcccgttaacaaagcagacgaggctgctaaaaagcacgatcaagaatacgatcaacagcttaaagcgggagacaatccctacataaaatataatcacgcggacgaacagttccagaaagacctacaaggtgataccagtctagccggcaacgcggctaacgctctatttcaaggcaaaaagactctactagcgccccttggcctagtagagacccctgtcggcaaaacgtctgaaaagcacaaattagacgaatactatcctaaagctaaaaaggccaaacaaggcttgcagataccagctccacctaaaggcggagaagaagaagctacatcgtcacaatctggagggagcccagcaggttccgatactagcggcacatctgtcatggctacaggaggaggcggtccgatggcagacgataaccagggcgccgagggagtgggtaattcctcaggtgattggcattgcgataccaagtggatgggagaccacgtcattacaaagtcaaccagaacttgggtgctccccacttacgggaatcatctctacgggcctatcaactttgacggcaccacaggttcgggtgctaatgcagcctatgcaggatacaagactccctgggggtactttgacttcaatcgattccattgccacttctccccccgagactggcaaagactcatcaacaaccacacaggcatcaggccgaaaggactcaaaatcaaagtctttaacgtccaagtcaaagaagttacaacacaagattcaacgaaaacaattgccaacaatctcaccagcaccgtacagatctttgcggacgagaactacgacttaccatatgtattaggcagtgctacacaaggcacatttcctccatttcccaatgatgtatttatgttaccacaatatgcttattgtacacttcaaggaaattcggggaaatttgtagatagaagtgccttttattgtttagaatattttccttcacaaatgctgagaacaggaaacaattttgagttccagtttaaatttgaagaagttccctttcattctggatgggcacagagtcaaagcctagacagattgatgaatccgttgcttgatcaatatctgataggagactatggaacagatgcatcaggaaaccttatttatcacagagctggtccaaatgatttgaatgaattctacaagaattgggcacctgcaccctatgaatgtatccagaatattaacagcagtgataataccaagaatgctaattctataaatggttcaaattctaccaacaaatggggactacaaggaagacaagcatgggatgctccaggatttgttcaagctagtacctatgaaggtgcagcagcaggacaatctcttcttaatggcgtacttactttcgataaaagttcagctactacttcatctccagctgctactgcagtaaacagaacaattgaagacgaaatacagggtaccaataattttggtaatgctagaaataacattgttgctatcaatcaacaaacgaaaggaacaaatccaacaacaggtagtacatctcaatttgagacaatgccaggtatggtgtggtctaatagagacatttacttacaggggcctatttgggctaaaattccaaatacagatggacattttcatccttctcccagaatgggtggttttggattaaaacatcctccgcctatgattctgatcaaaaatacaccagttcctgctgatcctccaactaccttcaatccaatgccacagactagtttcattactgaatacagtacaggacaagtaactgttgaaatgttgtgggaggtacagaaagaatcctccaaaagatggaatccagaagtacagtttacttccaattttggaacttcagatccagctgttgatggaataccgtttggaattaataatttgggtacttatgttgaatctagacctattggaactcgttatatttctaaacacttgtaa

SEQ ID NO: 414 - protein, 738 aa, Non-human primate Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 415 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPARKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSSSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 416 - protein, 742 aa, Adeno-associated virus
MAADGYLPDWLEDNLSEGIREWWALKPGAPQPKANQQHQDNGRGLVLPGYKYLGPFNGLDKGEPVNEADAAALEHDKAYDKQLEQGDNPYLKYNHADAEFQQRLATDTSFGGNLGRAVFQAKKRILEPLGLVEEGVKTAPGKKRPLEKTPNRPTNPDSGKAPAKKKQKDGEPADSARRTLDFEDSGAGDGPPEGSSSGEMSHDAEMRAAPGGNAVEAGQGADGVGNASGDWHCDSTWSEGRVTTTSTRTWVLPTYNNHLYLRIGTTANSNTYNGFSTPWGYFDFNRFHCHFSPRDWQRLINNNWGLRPKSMRVKIFNIQVKEVTTSNGETTVANNLTSTVQIFADSTYELPYVMDAGQEGSFPPFPNDVFMVPQYGYCGVVTGKNQNQTDRNAFYCLEYFPSQMLRTGNNFEVSYQFEKVPFHSMYAHSQSLDRMMNPLLDQYLWHLQSTTTGNSLNQGTATTTYGKITTGDFAYYRKNWLPGACIKQQKFSKNANQNYKIPASGGDALLKYDTHTTLNGRWSNMAPGPPMATAGAGDSDFSNSQLIFAGPNPSGNTTTSSNNLLFTSEEEIATTNPRDTDMFGQIADNNQNATTAPHIANLDAMGIVPGMVWQNRDIYYQGPIWAKVPHTDGHFHPSPLMGGFGLKHPPPQIFIKNTPVPANPNTTFSAARINSFLTQYSTGQVAVQIDWEIQKEHSKRWNPEVQFTSNYGTQNSMLWAPDNAGNYHELRAIGSRFLTHHL

SEQ ID NO: 417 - protein, 738 aa, Artificial Sequence
  Description of Artificial Sequence: Synthetic polypeptide
MSLISDAIPDWLERLVKKGVNAAADFYHLESGPPHPKANQQTQESPEKDDSRGLVFPGYKYLGPFNGLDKGKPVNEADAAALEHDKAYDLELKDGHNPYFEYNEADRRFQERLKDDTSFGGNLGKAIFQAKKRVLEPFGLIEQPDNTAGTGEKRPERVDDFFPKKKKAKTEQGKAPAQTGEDPGEGTSSNAGSSAPSSVGSSVMAEGGGGPMGDAGQGADGVGNSSGNWHCDSQWLDNGVVTRTTRTWVLPSYNNHLYKRIQGPGGTDPNNKFFGFSTPWGYFDYNRFHCHFSPRDWQRLINNNWGIRPKAMRFRLFNIQVKEVTVQDSNTTIANNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQTGSSGRALNYSRATKTNMATQYRNWLPGPFVRDQQIFTGASNITQNNVFNVWDKGKQWVIDNRINMMQPGPAAATTFSGEPDRQAMQNTLAFSRTVYDQTTSTTDRNQLLITNEDEIRPTNSVGIDTWGVVPNNNQSKVTAGTRAAINNQGALPGMVWQNRDIYLQGPIWAKIPDTDNHFHPSPLIGGFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 418 - protein, 724 aa, Artificial Sequence
  Description of Artificial Sequence: Synthetic polypeptide
MSFVDHPPDWLEEIGEGLSEFIGLEAGPPKPKPGYQDRARGLVVPGYKYLGPFNGLDRGEPVNAADAAAKKHDEEYDRLLKAGDNPYLAYNHADAEFQKDLSGDSSLAGNAANALFQAKKRVLEPFGLVEGEPEPKKTPSVKRPHASPDSSSGVGKKGDQPARKRLDFGTEPAGQDGAGRAAQAAGDMASAEVAAGGGGPVGDDAQGADGVGNASGNWHYDSVWMDGAVITKSTRTWSLPAYNNHLYRQIQSSGTGDGTYFGYSTPWGYFDFNRFHCHFSPRDWQRLINNHWGIRPKRLHFKLFNIQVKEVTTTDGTTTIANNLTSTIQVFADTEYQLPYVLGNAHEGCLPPFPADVFMLPQYAYLTLNANPTNQGAAALSLPQSAFYCLEYFPSQMLRTGNNFSFSYEFEKLPFHSMFMHSQSLDRLMNPLIDQYLWYLNATTGNNLSFNKAGAKNFPEYFRNWLPGPGQRVQQWSTIGTQNNAQTGTWASANKWILMGRSSKMAPGLAQPVRNAQTVTNGSQLIFNNETIKGSTATASTVHSGLLVTNESETAPTNPNSATKWGVMTDNQQTTSTTPTVSDDLEAHVFPGMVWQDRDIYLQGPIWAKIPETDGHFHPSPLMGGFGLKNPPPQILVKNTPVPAVPPTTFTPQKVNSFITQYSTGQVTVEIEWELRKEKSKRWNPEIQYTSNFENSANVQFSVNGDGAYIEPRPIGTRYLTHNL

SEQ ID NO: 419 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 420 - protein, 726 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNGDNPTERSSFFCLEYFPSKMLRTGNNFEFTYSFEEVPFHCSFAPSQNLFKLANPLVDQYLYRFVSTSATGAIQFQKNLAGRYANTYKNWFPGPMGRTQGWNTSSGSSTNRVSVNNFSVSNRMNLEGASYQVNPQPNGMTNTLQGSNRYALENTMIFNAQNATPGTTSVYPEDNLLLTSESETQPVNRVAYNTGGQMATNAQNATTAPTVGTYNLQEVLPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDGSGEYRTTRAIGTRYLTRPL

SEQ ID NO: 421 - protein, 713 aa, Artificial Sequence
  Description of Artificial Sequence: Synthetic polypeptide
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKRLNGTTSGDQSYFGFSTPWGYFDFNRFHCHFSPRDWQRLINNNWGLRPKSLRFKIFNIQVKEVTTQDSTKIISNNLTSTVQVFADTEYQLPYVIGSAHEGCLPPFPADVFMLPQYGYCTRQDGNSNNPTPRSAFYCLEYFPSKMLRTGNSFEFTYNFEKVPFHSMWAHNQSLDRLMNPLIDQYLYYLDVTSSTGFTYQKGVHTNLPEQERNWLPGPGIRNQAWFNSATGNNPLTGTWQYSNKYVLENRASKIAPGPAMGIESTKFDGNGIIFSKEYITNVNTANPNQVNITRETEINSTNPLAGGSLGAHANNSQNTTTAPTLDHTNVMGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYSDDSSSTSGSILHFAPDDVGNYKEFRSIGTRYLTRPL

SEQ ID NO: 422 - protein, 727 aa, Artificial Sequence
  Description of Artificial Sequence: Synthetic polypeptide
MSFVDHPPDWLEEVGEGLHEFLELEAGPPKPKPNQQKQDNARGLVLPGYNYLGPFNGLDKGEPVNRADAVAREHDISYNEQLQAGDNPYLKYNHADAEFQEKLKDDTSFGGNLGKAIFQAKKRVLEPFGLVEAPVKTAPAKKRPIEKSPAEPSSSKGIGKAGQQPARKRLNFGQTGDTDSAADPQPLGEPPAAPSGLGTGTMASGGGAPMADNNEGADGVGNASGNWHCDSTWLGDRVITTSTRTWALPTYNNHLYKQISSSNYGANNDNHYFGYSTPWGYFDFNRFHCHFSPRDWQRLINNNWGFRPKRLNFKLFNIQVKEVTETDGTKTIANNLTSTVQVFADSEYQLPYVLGSAHQGCFPPFPADVFMIPQYGYLTLNNGSQAMGRSSFYCLEYFPSQMLRTGNNFTFSYTFEDVPFHSSYAHSQSLDRLMNPLIDQYLYYLSKTAGGLAFSQAGPTTMRNQSRNWLPGPCFRQQRVSERSTENNNGDFSWTGTTRYHLNGRDSAMNPGPAMASHKDDEDRFFPQNGVLIFGTPNATASNAPLENVLITDEEEIRTTNPVATEEYGIVANNKQDSSTQATTAIVNAQGILPGMVWQDRDVYLQGPIWAKIPHTDGHFHPSPLMGGFGLKHPPPQILIKNTPVPSNPPEKFTQEKLNAFITQYSTGQVSVEIEWELQKENSKRWNPEVQYTSNYNKSVNVDFTVDTNGMYSEPRTIGTRYLTRNL

SEQ ID NO: 423 - protein, 734 aa, Artificial Sequence
  Description of Artificial Sequence: Synthetic polypeptide
MSFFDWIGRKYANGAAEFWDLEPGPPKPKKARVDDSAGFNFPGHKYLGPGNGLDRGEPVDADDAAAQKHDQEYQALLESGENPYLTFNHADRQLQKDLAEDQSFEGNLARGLFEAKKLAAQVVGVEEPELAPPVKRPHSPEKTPENQKGQPRPDPRTPAKKRLEFSDQPGSSADLPASSQQSQPPAGVPGVVPGTMSAGGGAPVDDAQQGADGVGNASGDWHCDSKWLGNRVLTRSTRTWVLPSYNNHLYKQISDASGVHSLPGSRYFGYSTPWGYFDFNRFHCHFSPRDWQRLVNNHWGFRPKRLRVKLFNIQVKEVTTTDSTTTVSNNLTSTVQVFTDDEYQLPYVCGNATEGCLPPFPPDVFTLPQYGYATLNDSNNGNPTNRSSFFCLEYFPSKMLRTGNNFEFTFEFEDVPFHTGFAPCQNLFKLSNPLVDQYLYRFQGTDNSSSSTPGVVKFEKCVAHNYAQQYKNWLTGAFQRNQDYNYVSGTSNYKGVVGSNQNNLQRIENVQFAIAPDVPSMCNHLEGTNMIALDNSLIFRDVSTAPGDTTQYNINQVIVTSEAETQSVNAYSGDTCGRIVNNSQNSGTNAGTTGINYKGTMPSSVWMDRDVYLQGPIWAKIPHTGAHFHPSPMMGGFGLRNPPPMMLIKNTPVPGNVTTFTEVKVNQFITQYSTGQITVDVEWELQKENSKRWNPEIQYTNNYSNNTFVDFAPNANGDYQMTRPIGTRYPTRPP

SEQ ID NO: 424 - protein, 718 aa, Artificial Sequence
  Description of Artificial Sequence: Synthetic polypeptide
MSSLFKEYLQSTGLVGIQSGAPKPKAGQQKQDTGSFEWKKKEDTARGLVLPGYKYLGPFNGLERGEPVNAADAAAQRHDRQYDRILQQGGNPYLTYNHADREFQEELQSDESFGGNLGKAVFQAKKRILEPLGLVEEDPSQPDSSSDNTAPPVKKSRLEEAQPIQSPDVSSSTGGGIADVMSGDAEMAAVGGGAPGVDGQGAEGVGTSSGNWHCDSQWSEGHVRTTSTRTWVLPSYNNHLYKRLGSSAQSNTYNGFSTPWGYLDFNRWHCHFSPRNWQRLINNNWGIRPKRLNVKLFNIQVKEVTTEGGTTTVANNLTSTIQVFADNAYELPYVVDAGHEGALPPFPNDVFMIPQYGYCGLVSGQSQNQSDLCSFYCLEYFPSQMLRTGNNFEMNFRFEDVPFHSMYAHSQSLDRLMNPLIDQYLWSLKQTGNPTGSTTRDLKFIKNKVPNFAHYGKNWLPGPFIRQQGWTTQNINNSVVNFNDMLGKNSTFTLDTRWSSLAPGPCMGDDGRTPSTTKFSNAQLMFGSGTQPTEGGEDAVHITSESEVKATNPTAIDEYGRVADNTQNATTAPTTVGNAAMGAMPGMVWQDRDIYLQGPIWGKIPHTDGHFHPSPLMGGFGYRKPPPQIFIKNTPVPGNPATTFSPNRINNFITQYSTGQVTVTIDWELQKENSKRWNPEVQFTSNFGTVDSLNWAPDNAGNYKEPRVVGSRFLTHIL

SEQ ID NO: 425 - protein, 726 aa, Artificial Sequence
  Description of Artificial Sequence: Synthetic polypeptide
MDFLDDFFADKYKETVNELGKPVNPKPVKHISEAHSQPGSRRGFVVPGYRYLGPGNSLDRGKPVNKADEAAKKHDQEYDQQLKAGDNPYIKYNHADEQFQKDLQGDTSLAGNAANALFQGKKTLLAPLGLVETPVGKTSEKHKLDEYYPKAKKAKQGLQIPAPPKGGEEEATSSQSGGSPAGSDTSGTSVMATGGGGPMADDNQGAEGVGNSSGDWHCDTKWMGDHVITKSTRTWVLPTYGNHLYGPINFDGTTGSGANAAYAGYKTPWGYFDFNRFHCHFSPRDWQRLINNHTGIRPKGLKIKVFNVQVKEVTTQDSTKTIANNLTSTVQIFADENYDLPYVLGSATQGTFPPFPNDVFMLPQYAYCTLQGNSGKFVDRSAFYCLEYFPSQMLRTGNNFEFQFKFEEVPFHSGWAQSQSLDRLMNPLLDQYLIGDYGTDASGNLIYHRAGPNDLNEFYKNWAPAPYECIQNINSSDNTKNANSINGSNSTNKWGLQGRQAWDAPGFVQASTYEGAAAGQSLLNGVLTFDKSSATTSSPAATAVNRTIEDEIQGTNNFGNARNNIVAINQQTKGTNPTTGSTSQFETMPGMVWSNRDIYLQGPIWAKIPNTDGHFHPSPRMGGFGLKHPPPMILIKNTPVPADPPTTFNPMPQTSFITEYSTGQVTVEMLWEVQKESSKRWNPEVQFTSNFGTSDPAVDGIPFGINNLGTYVESRPIGTRYISKHL

SEQ ID NO: 426 - protein, 737 aa, Artificial Sequence
  Description of Artificial Sequence: Synthetic polypeptide
MAADGYLPDWLEDNLSEGIREWWALKPGAPKPKANQQHQDDGRGLVLPGYKYLGPFNGLDKGEPVNAADAAALEHDKAYDQQLKAGDNPYLKYNHADAEFQERLQEDTSFGGNLGRAVFQAKKRLLEPLGLVEEGAKTAPGKKRPVEPSPQEPDSSTGIGKKGQQPARKRLNFGQTGDSESVPDPQPLGEPPAAPSGLGSNTMAAGGGAPMADNNEGADGVGSSSGNWHCDSTWLGDRVITTSTRTWALPTYNNHLYKQISNSTSGGSTNDNTYFGYSTPWGYFDFNRFHCHFSPRDWQRLINNNWGFRPKRLSFKLFNIQVKEVTQNEGTKTIANNLTSTVQVFTDSDYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSKTQTTGGTAGTQTLAFSQAGPSTMANQAKNWLPGPCYRQQRVSTTVGQNNNSNFAWTGATKYHLNGRDSLVNPGVAMATHKDDEEKFFPSSGVLIFGKQGAGKDNVDYSSVMITDEEEIKTTNPVATEEYGVVADNLQQAQTAPQTGAVNTQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 427 - protein, 737 aa, Artificial Sequence
  Description of Artificial Sequence: Synthetic polypeptide
MAADGYLPDWLEDTLSEGIRQWWDLKPGAPKPKANEQHQDDGRGLVLPGYKYLGPFNGLDKGEPVNAADAAALEHDKAYDQQLKSGDNPYLKYNHADAEFQERLKEDTSFGGNLGRAVFQAKKRVLEPLGLVEEGAKTAPGKKRPVEQSPQEPDSSSGIGKSGQQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISNGSSGGSSNDNTYFGYSTPWGYFDFNRFHCHFSPRDWQRLINNNWGFRPKRLNFKLFNIQVKEVTQNDGTKTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLSRTNTTSGTTGQQTLAFSQAGPSDIADQARNWLPGPCYRQQRVSTTVAQNNNSEYAWTGATKYHLNGRDSLVNPGPAMASHKDDEEKFFPSSGVLIFGKQGAGKDNVDISKVMITDEEEIRTTNPVATEQYGVVSTNLQSANAQAQTGAVNNQGVLPGMVWQDRDVYLQGPIWAKIPHTDGNFHPSPLMGGFGLKHPPPQILIKNTPVPANPPTTFSQAKFASFITQYSTGQVSVEIEWELQKENSKRWNPEIQYTSNYYKSTNVDFAVDTNGVYSEPRPIGTRYLTRNL

SEQ ID NO: 428 - protein, 737 aa, Artificial Sequence
  Description of Artificial Sequence: Synthetic polypeptide
MAADGYLPDWLEDNLSEGIREWWALKPGAPKPKANEQHQDDSRGLVLPGYKYLGPFNGLDKGEPVNAADAAALEHDKAYDQQLKSGDNPYLKYNHADAEFQERLKEDTSFGGNLGRAVFQAKKRVLEPLGLVEEAAKTAPGKKRPVEQSPQEPDSSSGIGKSGQQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSSTSGGSSNDNAYFGYSTPWGYFDFNRFHCHFSPRDWQRLINNNWGFRPKRLNFKLFNIQVKEVTQNDGTKTIANNLTSTVQVFTDSEYQLPYVLGSAHQGCLPPFPADVFMVPQYGYLTLNNGSQAVGRSSFYCLEYFPSQMLRTGNNFEFSYTFEDVPFHSSYAHSQSLDRLMNPLIDQYLYYLSRTNTTSGSAGQQTLKFSQPGPSDISAQSRNWLPGPCYRQQRVSTTVSDNNNSEFSWTGATKYHLNGRDSLVNPGPAMASHKDDEEKFFPSSGVLIFGKQGSGKDNVDIEKVMITDEEEIRTTNPVATEQYGQVSTNLQSGNAQAQTAAVNTQGVLPGMVWQDRDVYLQGPIWAKIPHTDGNFHPSPLMGGFGLKHPPPQILIKNTPVPANPPTTFSKAKFASFITQYSTGQVSVEIEWELQKENSKRWNPEIQYTSNYYKSTNVDFAVDTNGVYSEPRPIGTRYLTRNL

SEQ ID NO: 429 - protein, 533 aa, Artificial Sequence
  Description of Artificial Sequence: Synthetic consensus sequence
MAAGGGAPMADNNEGADGVGNSSGNWHCDSTWLGDRVITTSTRTWALPTYNNHLYKQISSGSGGASNDNAYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFQFSYTFEEVPFHSSYAHSQSLDRLMNPLIDQYLYYLSRTQNTGGTQNQQTLFSQAGPSGMAVQYKNWLPGPCYRQQRVSKTSTQNNNSNFAWTGASKYHLNGRNSLVNPGPAMASHKDDEEKFFPLSGVLIFGKQGAGRDNVDYDKVMITSEEEIKTTNPVATEQYGQVATNLQSSNTAPATGTVNAQGILPGMVWQDRDVYLQGPIWAKIPHTDGHFHPSPLMGGFGLKHPPPQILIKNTPVPANPPTTFSAAKFASFITQYSTGQVSVEIEWELQKENSKRWNPEIQYTSNYYKSQNVDFAVDTEGVYSEPRPIGTRYLTRNL

SEQ ID NO: 430 - protein, 533 aa, Adeno-associated virus; identical to SEQ ID NO: 24

SEQ ID NO: 431 - protein, 534 aa, Adeno-associated virus
MASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 432 - protein, 532 aa, Adeno-associated virus
MSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 433 - protein, 535 aa, Adeno-associated virus
MAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 434 - protein, 534 aa, Adeno-associated virus
MASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 435 - protein, 735 aa, Adeno-associated virus [sequence omitted]

SEQ ID NO: 436 - protein, 736 aa, Adeno-associated virus; identical to SEQ ID NO: 331

SEQ ID NO: 437 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 438 - protein, 738 aa, Adeno-associated virus; identical to SEQ ID NO: 414

SEQ ID NO: 439 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 440 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 441 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLEAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPVTGSCFWQQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 442 - protein, 737 aa, Adeno-associated virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 443 - protein, 8 aa, Artificial Sequence
  Description of Artificial Sequence: Synthetic peptide
NGTSGGAT

SEQ ID NO: 444 - protein, 7 aa, Artificial Sequence
  Description of Artificial Sequence: Synthetic peptide
NSTSGGS

SEQ ID NO: 445 - protein, 8 aa, Artificial Sequence
  Description of Artificial Sequence: Synthetic peptide
NGTSGGST

SEQ ID NO: 446 - protein, 11 aa, Artificial Sequence
  Description of Artificial Sequence: Synthetic peptide
QTTGGTANTQT

SEQ ID NO: 447 - protein, 10 aa, Artificial Sequence
  Description of Artificial Sequence: Synthetic peptide
INGSGQNQQT

SEQ ID NO: 448 - protein, 11 aa, Artificial Sequence
  Description of Artificial Sequence: Synthetic peptide
QTTGGTTNTQT

SEQ ID NO: 449 - protein, 11 aa, Artificial Sequence
  Description of Artificial Sequence: Synthetic peptide
QSTGGTAGTQQ

SEQ ID NO: 450 - protein, 10 aa, Artificial Sequence
  Description of Artificial Sequence: Synthetic peptide
QTTGTGGTQT

SEQ ID NO: 451 - protein, 12 aa, Adeno-associated virus
QISSGSGGASND

SEQ ID NO: 452 - protein, 11 aa, Adeno-associated virus
QISSQSGASND

SEQ ID NO: 453 - protein, 12 aa, Adeno-associated virus
QISSASTGASND

SEQ ID NO: 454 - protein, 12 aa, Adeno-associated virus
EIKSGSVDGSNA

SEQ ID NO: 455 - protein, 13 aa, Adeno-associated virus
QISNGTSGGATND

SEQ ID NO: 456 - protein, 13 aa, Adeno-associated virus
QISNSTSGGSSND

SEQ ID NO: 457 - protein, 5 aa, Adeno-associated virus
NDGTT

SEQ ID NO: 458 - protein, 5 aa, Adeno-associated virus
NDGVT

SEQ ID NO: 459 - protein, 5 aa, Adeno-associated virus
QDSTT

SEQ ID NO: 460 - protein, 5 aa, Adeno-associated virus
NEGTK

SEQ ID NO: 461 - protein, 5 aa, Adeno-associated virus
NNGVK

SEQ ID NO: 462 - protein, 4 aa, Adeno-associated virus
NNGS

SEQ ID NO: 463 - protein, 6 aa, Adeno-associated virus
NRDNTE

SEQ ID NO: 464 - protein, 4 aa, Adeno-associated virus
NDGS

SEQ ID NO: 465 - protein, 10 aa, Adeno-associated virus
NTGGTQNQQT

SEQ ID NO: 466 - protein, 10 aa, Adeno-associated virus
TPSGTTTQSR

SEQ ID NO: 467 - protein, 10 aa, Adeno-associated virus
NQSGSAQNKD

SEQ ID NO: 468 - protein, 9 aa, Adeno-associated virus
NTGGVQFNK

SEQ ID NO: 469 - protein, 10 aa, Adeno-associated virus
TTGGTANTQT

SEQ ID NO: 470 - protein, 9 aa, Adeno-associated virus
NGSGQNQQT

SEQ ID NO: 471 - protein, 18 aa, Adeno-associated virus
RVSKTSTQNNNSNFAWTG

SEQ ID NO: 472 - protein, 18 aa, Adeno-associated virus
RVSKTSADNNNSEYSWTG

SEQ ID NO: 473 - protein, 18 aa, Adeno-associated virus
RVSKTKTDNNNSNFTWTG

SEQ ID NO: 474 - protein, 18 aa, Adeno-associated virus
GWNLGSGVNRASVSAFAT

SEQ ID NO: 475 - protein, 18 aa, Adeno-associated virus
RVSTTTGQNNNSNFAWTA

SEQ ID NO: 476 - protein, 18 aa, Adeno-associated virus
RVSTTVTQNNNSEFAWPG

SEQ ID NO: 477 - protein, 13 aa, Adeno-associated virus
HKDDEEKFFPLSG

SEQ ID NO: 478 - protein, 13 aa, Adeno-associated virus
HKDDEEKFFPQSG

SEQ ID NO: 479 - protein, 13 aa, Adeno-associated virus
HKDDEDKFFPMSG

SEQ ID NO: 480 - protein, 13 aa, Adeno-associated virus
NNLQGSNTYALEN

SEQ ID NO: 481 - protein, 13 aa, Adeno-associated virus
HKDDEERFFPSNG

SEQ ID NO: 482 - protein, 13 aa, Adeno-associated virus
HKEGEDRFFPLSG

SEQ ID NO: 483 - protein, 14 aa, Adeno-associated virus
KQGAGRDNVDYDKV

SEQ ID NO: 484 - protein, 14 aa, Adeno-associated virus
KQGSEKTNVDIEKV

SEQ ID NO: 485 - protein, 14 aa, Adeno-associated virus
KESAGASNTALDNV

SEQ ID NO: 486 - protein, 17 aa, Adeno-associated virus
SQPANPGTTATYLEGNM

SEQ ID NO: 487 - protein, 14 aa, Adeno-associated virus
KQNAARDNADYSDV

SEQ ID NO: 488 - protein, 14 aa, Adeno-associated virus
KQGTGRDNVDADKV

SEQ ID NO: 489 - protein, 13 aa, Adeno-associated virus
ATNLQSSNTAPAT

SEQ ID NO: 490 - protein, 13 aa, Adeno-associated virus
STNLQRGNRQAAT

SEQ ID NO: 491 - protein, 13 aa, Adeno-associated virus
AVNFQSSSTDPAT

SEQ ID NO: 492 - protein, 13 aa, Adeno-associated virus
ATNNQSSTTAPAT

SEQ ID NO: 493 - protein, 13 aa, Adeno-associated virus
ADNLQQQNTAPQI

SEQ ID NO: 494 - protein, 13 aa, Adeno-associated virus
ATNHQSAQAQAQT

SEQ ID NO: 495 - protein, 20 aa, Adeno-associated virus
VPANPPTTFSAAKFASFITQ

SEQ ID NO: 496 - protein, 20 aa, Adeno-associated virus
VPANPSTTFSAAKFASFITQ

SEQ ID NO: 497 - protein, 20 aa, Adeno-associated virus
VPANPPAEFSATKFASFITQ

SEQ ID NO: 498 - protein, 19 aa, Adeno-associated virus
VPGNITSFSDVPVSSFITQ

SEQ ID NO: 499 - protein, 20 aa, Adeno-associated virus
VPADPPTTFNQSKLNSFITQ

SEQ ID NO: 500 - protein, 20 aa, Adeno-associated virus
VPADPPTAFNKDKLNSFITQ

SEQ ID NO: 501 - protein, 10 aa, Adeno-associated virus
SNYYKSQNVD

SEQ ID NO: 502 - protein, 10 aa, Adeno-associated virus
SNYNKSVNVD

SEQ ID NO: 503 - protein, 10 aa, Adeno-associated virus
SNYAKSANVD

SEQ ID NO: 504 - protein, 10 aa, Adeno-associated virus
NNYNDPQFVD

SEQ ID NO: 505 - protein, 10 aa, Adeno-associated virus
SNYYKSTSVD

SEQ ID NO: 506 - protein, 10 aa, Adeno-associated virus
SNYYKSNNVE

SEQ ID NO: 507 - protein, 30 aa, Adeno-associated virus
DTLSEGIRQWWKLKPGPPPPKPAERHKDDS

SEQ ID NO: 508 - protein, 30 aa, Adeno-associated virus
DNLSEGIREWWALKPGAPQPKANQQHQDNA

SEQ ID NO: 509 - protein, 30 aa, Adeno-associated virus
DNLSEGIREWWDLKPGAPKPKANQQKQDDG

SEQ ID NO: 510 - protein, 30 aa, Adeno-associated virus
DNLSEGIREWWALKPGAPKPKANQQKQDDG

SEQ ID NO: 511 - protein, 30 aa, Adeno-associated virus
DNLSEGIREWWDLKPGAPKPKANQQKQDNG

SEQ ID NO: 512 - protein, 40 aa, Adeno-associated virus
NEADAAALEHDKAYDRQLDSGDNPYLKYNHADAEFQERLK

SEQ ID NO: 513 - protein, 40 aa, Adeno-associated virus
NAADAAALEHDKAYDQQLKAGDNPYLKYNHADAEFQERLK

SEQ ID NO: 514 - protein, 40 aa, Adeno-associated virus
NAADAAALEHDKAYDQQLKAGDNPYLRYNHADAEFQERLQ

SEQ ID NO: 515 - protein, 40 aa, Adeno-associated virus
NAADAAALEHDKAYDQQLQAGDNPYLRYNHADAEFQERLQ

SEQ ID NO: 516 - protein, 40 aa, Adeno-associated virus
NAADAAALEHDKAYDQQLEAGDNPYLRYNHADAEFQERLQ

SEQ ID NO: 517 - protein, 29 aa, Adeno-associated virus
PVKTAPGKKRPVEHSPVEPDSSSGTGKAG

SEQ ID NO: 518 - protein, 29 aa, Adeno-associated virus
AAKTAPGKKRPVEQSPQEPDSSAGIGKSG

SEQ ID NO: 519 - protein, 29 aa, Adeno-associated virus
GAKTAPGKKRPVEQSPQEPDSSSGIGKTG

SEQ ID NO: 520 - protein, 30 aa, Adeno-associated virus
GAKTAPGKKRPVEPSPQRSPDSSTGIGKKG

SEQ ID NO: 521 - protein, 30 aa, Adeno-associated virus
AAKTAPGKKRPVEPSPQRSPDSSTGIGKKG

SEQ ID NO: 522 - protein, 29 aa, Adeno-associated virus
GAKTAPGKKRPVEQSPQEPDSSSGIGKKG

SEQ ID NO: 523 - protein, 30 aa, Adeno-associated virus
GAKTAPAKKRPVEPSPQRSPDSSTGIGKKG

SEQ ID NO: 524 - protein, 46 aa, Adeno-associated virus
DADSVPDPQPLGQPPAAPSGLGTNTMATGSGAPMADNNEGADGVGN

SEQ ID NO: 525 - protein, 46 aa, Adeno-associated virus
DTESVPDPQPIGEPPAAPSGVGSLTMASGGGAPVADNNEGADGVGS

SEQ ID NO: 526 - protein, 46 aa, Adeno-associated virus
DSESVPDPQPLGEPPAAPSGLGPNTMASGGGAPMADNNEGADGVGN

SEQ ID NO: 527 - protein, 46 aa, Adeno-associated virus
DSESVPDPQPIGEPPAGPSGLGSGTMAAGGGAPMADNNEGADGVGS

SEQ ID NO: 528 - protein, 46 aa, Adeno-associated virus
DSESVPDPQPLGEPPAAPSGVGPNTMAAGGGAPMADNNEGADGVGS

SEQ ID NO: 529 - protein, 46 aa, Adeno-associated virus
DSESVPDPQPLGEPPAAPSSVGSGTVAAGGGAPMADNNEGADGVGN

SEQ ID NO: 530 - protein, 10 aa, Adeno-associated virus
SQSGASNDNH

SEQ ID NO: 531 - protein, 12 aa, Adeno-associated virus
NSTSGGSSNDNA

SEQ ID NO: 532 - protein, 12 aa, Adeno-associated virus
NGTSGGSTNDNT

SEQ ID NO: 533 - protein, 12 aa, Adeno-associated virus
NGTSGGATNDNT

SEQ ID NO: 534 - protein, 11 aa, Adeno-associated virus
SETAGSTNDNT

SEQ ID NO: 535 - protein, 6 aa, Adeno-associated virus
QNDGTT

SEQ ID NO: 536 - protein, 6 aa, Adeno-associated virus
DNNGVK

SEQ ID NO: 537 - protein, 6 aa, Adeno-associated virus
TNEGTK

SEQ ID NO: 538 - protein, 6 aa, Adeno-associated virus
QNEGTK

SEQ ID NO: 539 - protein, 6 aa, Adeno-associated virus
TNDGVT

SEQ ID NO: 540 - protein, 9 aa, Adeno-associated virus
FTFSYTFED

SEQ ID NO: 541 - protein, 9 aa, Adeno-associated virus
FQFSYEFEN

SEQ ID NO: 542 - protein, 9 aa, Adeno-associated virus
FQFSYTFED

SEQ ID NO: 543 - protein, 9 aa, Adeno-associated virus
FEFSYQFED

SEQ ID NO: 544 - protein, 9 aa, Adeno-associated virus
FEFSYTFED

SEQ ID NO: 545 - protein, 9 aa, Adeno-associated virus
FQFTYTFED

SEQ ID NO: 546 - protein, 9 aa, Adeno-associated virus
FEFSYSFED

SEQ ID NO: 547 - protein, 29 aa, Adeno-associated virus
NTPSGTTTQSRLQFSQAGASDIRDQSRNW

SEQ ID NO: 548 - protein, 28 aa, Adeno-associated virus
INGSGQNQQTLKFSVAGPSNMAVQGRNY

SEQ ID NO: 549 - protein, 28 aa, Adeno-associated virus
QTTGTGGTQTLAFSQAGPSSMANQARNW

SEQ ID NO: 550 - protein, 29 aa, Adeno-associated virus
QSTGGTAGTQQLLFSQAGPNNMSAQAKNW

SEQ ID NO: 551 - protein, 29 aa, Adeno-associated virus
QSTGGTQGTQQLLFSQAGPANMSAQAKNW

SEQ ID NO: 552 - protein, 29 aa, Adeno-associated virus
QTTGGTANTQTLGFSQGGPNTMANQAKNW

SEQ ID NO: 553 - protein, 30 aa, Adeno-associated virus
QSNPGGTAGNRELQFYQGGPSTMAEQAKNW

SEQ ID NO: 554 - protein, 24 aa, Adeno-associated virus
KTSADNNNSEYSWTGATKYHLNGR

SEQ ID NO: 555 - protein, 24 aa, Adeno-associated virus
TTVTQNNNSEFAWPGASSWALNGR

SEQ ID NO: 556 - protein, 24 aa, Adeno-associated virus
TTTNQNNNSNFAWTGAAKFKLNGR

SEQ ID NO: 557 - protein, 24 aa, Adeno-associated virus
TTLSQNNNSNFAWTGATKYHLNGR

SEQ ID NO: 558 - protein, 24 aa, Adeno-associated virus
TTTGQNNNSNFAWTAGTKYHLNGR

SEQ ID NO: 559 - protein, 24 aa, Adeno-associated virus
KTLDQNNNSNFAWTGATKYHLNGR

SEQ ID NO: 560 - protein, 46 aa, Adeno-associated virus
VNPGPAMASHKDDEEKFFPQSGVLIFGKQGSEKTNVDIEKVMITDE

SEQ ID NO: 561 - protein, 46 aa, Adeno-associated virus
MNPGPAMASHKEGEDRFFPLSGSLIFGKQGTGRDNVDADKVMITNE

SEQ ID NO: 562 - protein, 46 aa, Adeno-associated virus
MNPGVAMASHKDDDDRFFPSSGVLIFGKQGAGNDGVDYSQVLITDE

SEQ ID NO: 563 - protein, 46 aa, Adeno-associated virus
VNPGVAMATHKDDEERFFPSSGVLMFGKQGAGKDNVDYSSVMLTSE

SEQ ID NO: 564 - protein, 46 aa, Adeno-associated virus
VNPGVAMATHKDDEERFFPSSGVLMFGKQGAGRDNVDYSSVMLTSE

SEQ ID NO: 565 - protein, 46 aa, Adeno-associated virus
ANPGIAMATHKDDEERFFPSNGILIFGKQNAARDNADYSDVMLTSE

SEQ ID NO: 566 - protein, 45 aa, Adeno-associated virus
ANPGIAMATHKDDEERFFPVTGSCFWQQNAARDNADYSDVMLTSE

SEQ ID NO: 567 - protein, 45 aa, Adeno-associated virus
VNPGVAMATHKDDEDRFFPSSGVLIFGKTGATNKTTLENVLMTNE

SEQ ID NO: 568 - protein, 53 aa, Adeno-associated virus
QYGSVSTNLQRGNRQAATADVNTQGVLPGMVWQDRDVYLQGPIWAKIPHTDGH

SEQ ID NO: 569 - protein, 53 aa, Adeno-associated virus
SYGQVATNHQSAQAQAQTGWVQNQGILPGMVWQDRDVYLQGPIWAKIPHTDGN

SEQ ID NO: 570 - protein, 53 aa, Adeno-associated virus
EYGAVAINNQAANTQAQTGLVHNQGVIPGMVWQNRDVYLQGPIWAKIPHTDGN

SEQ ID NO: 571 - protein, 53 aa, Adeno-associated virus
QYGVVADNLQQQNAAPIVGAVNSQGALPGMVWQNRDVYLQGPIWAKIPHTDGN

SEQ ID NO: 572 - protein, 53 aa, Adeno-associated virus
QYGVVADNLQQTNTGPIVGNVNSQGALPGMVWQNRDVYLQGPIWAKIPHTDGN

SEQ ID NO: 573 - protein, 53 aa, Adeno-associated virus
EYGIVADNLQQQNTAPQIGTVNSQGALPGMVWQNRDVYLQGPIWAKIPHTDGN

SEQ ID NO: 574 - protein, 53 aa, Adeno-associated virus
EYGIVSSNLQAANTAAQTQVVNNQGALPGMVWQNRDVYLQGPIWAKIPHTDGN

SEQ ID NO: 575 - protein, 13 aa, Adeno-associated virus
ANPSTTFSAAKFA

SEQ ID NO: 576 - protein, 13 aa, Adeno-associated virus
ADPPTAFNKDKLN

SEQ ID NO: 577 - protein, 13 aa, Adeno-associated virus
ADPPLTFNQAKLN

SEQ ID NO: 578 - protein, 13 aa, Adeno-associated virus
ADPPTTFSQAKLA

SEQ ID NO: 579 - protein, 13 aa, Adeno-associated virus
ADPPTTFNQSKLN

SEQ ID NO: 580 - protein, 13 aa, Adeno-associated virus
ANPPEVFTPAKFA

SEQ ID NO: 581 - protein, 13 aa, Adeno-associated virus
NKSVNVDFTVDTN

SEQ ID NO: 582 - protein, 13 aa, Adeno-associated virus
YKSNNVEFAVNTE

SEQ ID NO: 583 - protein, 13 aa, Adeno-associated virus
YKSTNVDFAVNTE

SEQ ID NO: 584 - protein, 13 aa, Adeno-associated virus
YKSTNVDFAVNTD

SEQ ID NO: 585 - protein, 13 aa, Adeno-associated virus
YKSTSVDFAVNTE

SEQ ID NO: 586 - protein, 13 aa, Adeno-associated virus
EKQTGVDFAVDSQ

The invention claimed is:

1. An adeno-associated virus (AAV) particle comprising a capsid protein, said capsid protein comprising a chimeric polypeptide which has at least 95% identity with a reference sequence comprising SEQ ID NO: 435; wherein the chimeric polypeptide is a substitutional variant of SEQ ID NO: 435; and wherein the chimeric polypeptide comprises one or more donor sequences, said one or more donor sequences selected from SEQ ID NOs: 465, 467-470, 548-553, and fragments of at least 4 amino acids thereof.

2. The AAV particle of claim 1, wherein said one or more donor sequences are selected from SEQ ID NOs: 469, 552, and fragments of at least 4 amino acids thereof.

3. The AAV particle of claim 1, wherein said one or more donor sequences are selected from SEQ ID NOs: 470, 548, and fragments of at least 4 amino acids thereof.

4. The AAV particle of claim 1, wherein said one or more donor sequences are selected from SEQ ID NO: 550, and fragments of at least 4 amino acids thereof.

5. The AAV particle of claim 1, wherein said one or more donor sequences are selected from SEQ ID NO: 549, and fragments of at least 4 amino acids thereof.

6. The AAV particle of claim 1, comprising a vector genome which comprises at least one payload region, wherein said payload region encodes a therapeutic protein for treatment of a neurological disease, disorder, and/or condition.

7. The AAV particle of claim 1, comprising a vector genome which comprises at least one payload region, wherein said payload region encodes an siRNA, an shRNA, a miRNA, or a precursor thereof.

8. The AAV particle of claim 7, wherein said payload region encodes an siRNA or a precursor thereof.

9. The AAV particle of claim 7, wherein said payload region encodes an miRNA or a precursor thereof.

10. The AAV particle of claim 1, wherein said one or more donor sequences are selected from SEQ ID NO: 553, and fragments of at least 4 amino acids thereof.

11. The AAV particle of claim 1, wherein said one or more donor sequences are selected from SEQ ID NO: 467, and fragments of at least 4 amino acids thereof.

12. The AAV particle of claim 1, wherein said one or more donor sequences are selected from SEQ ID NOs: 468, and fragments of at least 4 amino acids thereof.

13. The AAV particle of claim 1, wherein said one or more donor sequences are selected from SEQ ID NOs: 465, and fragments of at least 4 amino acids thereof.

14. The AAV particle of claim 1, wherein said one or more donor sequences are selected from SEQ ID NOs: 551, and fragments of at least 4 amino acids thereof.

15. The AAV particle of claim 1, wherein said chimeric polypeptide has at least 97% identity with the reference sequence comprising SEQ ID NO: 435.

16. The AAV particle of claim 1, wherein said chimeric polypeptide has at least 99% identity with the reference sequence comprising SEQ ID NO: 435.

17. An adeno-associated virus (AAV) capsid protein, said AAV capsid protein comprising a chimeric polypeptide which has at least 95% identity with a reference sequence comprising SEQ ID NO: 435; wherein the chimeric polypeptide is a substitutional variant of SEQ ID NO: 435; and wherein the chimeric polypeptide comprises one or more donor sequences selected from SEQ ID NOs: 465, 467-470, 548-553, and fragments of at least 4 amino acids thereof.

18. The AAV capsid protein of claim 17, wherein said one or more donor sequences are selected from SEQ ID NO: 465 and fragments of at least 4 amino acids thereof.

19. The AAV capsid protein of claim 17, wherein said one or more donor sequences are selected from SEQ ID NO: 467 and fragments of at least 4 amino acids thereof.

20. The AAV capsid protein of claim 17, wherein said one or more donor sequences are selected from SEQ ID NO: 468 and fragments of at least 4 amino acids thereof.

21. The AAV capsid protein of claim 17, wherein said one or more donor sequences are selected from SEQ ID NOs: 469, 552, and fragments of at least 4 amino acids thereof.

22. The AAV capsid protein of claim 17, wherein said one or more donor sequences are selected from SEQ ID NOs: 470, 548, and fragments of at least 4 amino acids thereof.

23. The AAV capsid protein of claim 17, wherein said one or more donor sequences are selected from SEQ ID NO: 549 and fragments of at least 4 amino acids thereof.

24. The AAV capsid protein of claim 17, wherein said one or more donor sequences are selected from SEQ ID NO: 550 and fragments of at least 4 amino acids thereof.

25. The AAV capsid protein of claim 17, wherein said one or more donor sequences are selected from SEQ ID NO: 551 and fragments of at least 4 amino acids thereof.

26. The AAV capsid protein of claim 17, wherein said one or more donor sequences are selected from SEQ ID NO: 553 and fragments of at least 4 amino acids thereof.

27. The AAV capsid protein of claim 17, wherein said chimeric polypeptide has at least 97% identity with the reference sequence comprising SEQ ID NO: 435.

28. The AAV capsid protein of claim 17, wherein said chimeric polypeptide has at least 99% identity with the reference sequence comprising SEQ ID NO: 435.

* * * * *